(12) United States Patent
Chng et al.

(10) Patent No.: US 11,959,108 B2
(45) Date of Patent: Apr. 16, 2024

(54) ENGINEERED PROTEASE VARIANTS

(71) Applicants: Codexis, Inc., Redwood City, CA (US); Societe des Produits Nestle S.A., Vevey (CH)

(72) Inventors: Chinping Chng, Menlo Park, CA (US); Nikki Dellas, San Carlos, CA (US); Ravi David Garcia, Los Gatos, CA (US); Moulay Hicham Alaoui Ismaili, San Mateo, CA (US); Kristen Jean Vallieu, Union City, CA (US); Kerryn McCluskie, Pacifica, CA (US)

(73) Assignees: Codexis, Inc., Redwood City, CA (US); Societe des Produits Nestle S.A., Vevey (CH)

( * ) Notice: Subject to any disclaimer, the term of this patent is extended or adjusted under 35 U.S.C. 154(b) by 43 days.

(21) Appl. No.: 17/460,141

(22) Filed: Aug. 27, 2021

(65) Prior Publication Data
US 2022/0090039 A1    Mar. 24, 2022

Related U.S. Application Data

(60) Provisional application No. 63/071,625, filed on Aug. 28, 2020.

(51) Int. Cl.
*C12N 9/48* (2006.01)
*A61K 38/48* (2006.01)
*A61P 1/18* (2006.01)

(52) U.S. Cl.
CPC ............. *C12N 9/48* (2013.01); *A61K 38/48* (2013.01); *A61P 1/18* (2018.01)

(58) Field of Classification Search
CPC ...................................................... C12N 9/48
See application file for complete search history.

(56) References Cited

U.S. PATENT DOCUMENTS

| | | | |
|---|---|---|---|
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,251,674 B1 | 6/2001 | Tobin et al. | |
| 6,265,201 B1 | 7/2001 | Wackett et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,337,186 B1 | 1/2002 | Krebber | |
| 6,344,356 B1 | 2/2002 | Stemmer | |
| 6,352,859 B1 | 3/2002 | delCardayre et al. | |
| 6,355,484 B1 | 3/2002 | Patten et al. | |
| 6,358,740 B1 | 3/2002 | Patten et al. | |
| 6,358,742 B1 | 3/2002 | Stemmer | |
| 6,365,377 B1 | 4/2002 | Patten et al. | |
| 6,365,408 B1 | 4/2002 | Stemmer | |
| 6,368,861 B1 | 4/2002 | Crameri et al. | |
| 6,372,497 B1 | 4/2002 | Stemmer | |
| 6,376,246 B1 | 4/2002 | Crameri et al. | |
| 6,379,964 B1 | 4/2002 | delCardayre et al. | |

(Continued)

FOREIGN PATENT DOCUMENTS

| WO | 95/22625 A1 | 8/1995 |
|---|---|---|
| WO | 96/00787 A1 | 1/1996 |

(Continued)

OTHER PUBLICATIONS

Parks et al., "A standardized bacterial taxonomy based on genome phylogeny substantially revises the tree of life", Nature Biotechnology, 2018, vol. 36, No. 10, pp. 996-1004. doi: 10.1038/nbt.4229.*
Gugger, M., et al., regulatory P domain of subtilisin-like proprotein convertases, GenBank Accession No. AFZ16257 dated Jul. 22, 2013.
International Search Report from corresponding PCT Application No. PCT/US2021/048105 dated Feb. 2, 2022.
Altschul, S., et al., "Basic local alignment search tool," J. Mol. Biol., 215: 403-410 [1990].
Altschul, S.F., et al., "Gapped BLAST and PSI-BLAST: a new generation of protein database search programs," Nucleic Acids Res., 25(17):3389-3402 [1997].
Beaucage, S.L., et al., "Deoxynucleoside phosphoamidites—A new class of key intermediates for deoxypolynucleotide synthesis," Tetrahedron Letters, 22(20):1859-62 [1981].
Black, M.E., et al., "Creation of drug-specific herpes simplex virus type 1 thymidine kinase mutants for gene therapy," Proc Natl Acad Sci USA, 93:3525-3529 [1996].

(Continued)

*Primary Examiner* — Suzanne M Noakes
(74) *Attorney, Agent, or Firm* — Codexis, Inc.

(57) ABSTRACT

The present invention provides engineered protease polypeptides and compositions thereof. The engineered protease polypeptides have been optimized to provide improved activity, improved thermostability, protease stability, autolytic stability, and stability under a range of pH conditions, including acidic (pH<7) and basic (pH>7) conditions. The invention also relates to the use of the compositions comprising the engineered protease polypeptides for therapeutic and/or nutritional purposes. The present invention also provides polynucleotides encoding the engineered protease polypeptides, as well as methods for making the engineered polynucleotides and protease polypeptides.

39 Claims, 2 Drawing Sheets

Specification includes a Sequence Listing.

(56) References Cited

U.S. PATENT DOCUMENTS

| | | |
|---|---|---|
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,553,653 B2 | 6/2009 | Kakkis et al. |
| 7,560,263 B2 | 7/2009 | Kakkis et al. |
| 7,620,500 B2 | 11/2009 | Mundorff et al. |
| 7,620,502 B2 | 11/2009 | Selifonov et al. |
| 7,629,157 B2 | 12/2009 | Davis et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 8,849,575 B2 | 9/2014 | Gustafsson et al. |
| 9,593,326 B2 | 3/2017 | Clark et al. |
| 9,665,694 B2 | 5/2017 | Cope |
| 9,684,771 B2 | 6/2017 | Cope et al. |
| 9,714,437 B2 | 7/2017 | Chan et al. |
| 9,864,833 B2 | 1/2018 | Fox |
| 9,996,661 B2 | 6/2018 | Gustafsson et al. |
| 2006/0195947 A1 | 8/2006 | Davis et al. |
| 2008/0220990 A1 | 9/2008 | Fox |
| 2009/0123452 A1 | 5/2009 | Madison |
| 2009/0312196 A1 | 12/2009 | Colbeck et al. |
| 2012/0177722 A1 | 7/2012 | Weiner et al. |
| 2013/0039898 A1 | 2/2013 | Okhamafe et al. |

FOREIGN PATENT DOCUMENTS

| | | |
|---|---|---|
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/152336 A1 | 12/2009 |
| WO | 2010/144103 A1 | 12/2010 |
| WO | 2017/213758 A1 | 12/2017 |

OTHER PUBLICATIONS

Botstein, D., et al., "Strategies and applications of in vitro mutagenesis," Science, 229(4719):1193-1201 [1985].

Caldwell, R.C., et al., "Mutagenic PCR," PCR Methods Appl., 3:S136-S140 [1994].

Carter, P., "Site-directed mutagenesis," Biochem. J., 237:1-7 [1986].

Christians, F.C., et al., "Directed evolution of thymidine kinase for AZT phosphorylation using DNA family shuffling," Nat. Biotechnol., 17:259-264 [1999].

Crameri, A., et al., "DNA shuffling of a family of genes from diverse species accelerates directed evolution", Nature, 391:288-291 [1998].

Crameri, A., et al., "Improved green fluorescent protein by molecular evolution using DNA shuffling," Nat. Biotechnol., 14(3):315-319 [1996].

Crameri, A., et al., "Molecular evolution of an arsenate detoxification pathway by DNA shuffling," Nat. Biotechnol., 15 (5):436-438 [1997].

Dale, S.J., et al., "Oligonucleotide-directed random mutagenesis using the phosphorothioate method," Methods Mol. Biol., 57:369-74 [1996].

Guo, Z., et al., "3'-End-Forming Signals of Yeast mRNA," Mol. Cell. Biol., 15(11):5983-5990 [1995].

Hagemeister, H., et al., "Plasma Amino Acids and Cholesterol Following Consumption of Dietary Casein or Soy Protein in Minipigs," J. Nutrition, 120:1305-1311 [1990].

Henikoff, S., et al., "Amino acid substitution matrices from protein blocks," Proc. Natl. Acad. Sci., 89:10915-10919 [1992].

Ikeda, K., et al., "Phenylalanine ammonia-lyase modified with polyethylene glycol: Potential therapeutic agent for phenylketonuria," Amino Acids, 29:283-287 [2005].

(56) References Cited

OTHER PUBLICATIONS

Kramer, B., et al., "Different base/base mismatches are corrected with different efficiencies by the methyl-directed DNA mismatch-repair system of *E. coli*," Cell, 38(3):879-887, [1984].

Ling, M., et al., "Approaches to DNA Mutagenesis:An Overview," Anal. Biochem., 254:157-78 [1997].

Matthes, H.W.D., et al., "Simultaneous rapid chemical synthesis of over one hundred oligonucleotides on a microscale," EMBO J., 3(4):801-05 [1984].

Minshull, J., et al., "Protein evolution by molecular breeding," Curr. Op. Chem. Biol., 3(3):284-290 [1999].

Needleman, S., et al., "A general method applicable to the search for similarities in the amino acid sequence of two proteins," J. Mol. Biol. 48:443-453 [1970].

Pearson, W.R., "Improved tools for biological sequence comparison," Proc. Nat'l. Acad. Sci. USA, 85:2444-2448 [1988].

Romanos, M.A., et al., "Foreign gene expression in yeast: a review," Yeast 8:423-488 [1992].

Smith, M., "In vitro mutagenesis," Ann. Rev. Genet., 19:423-462 [1985].

Smith, T., et al., "Comparison of Biosequences," Adv. Appl. Math, 2:482-489 [1981].

Stemmer, W., "DNA Shuffling by Random Fragmentation and Reassembly: In vitro Recombination for Molecular Evolution," Proc. Natl. Acad. Sci. USA, 91:10747-10751 [1994].

Stemmer, W.P.C., "Rapid evolution of a protein in vitro by DNA shuffling", Nature, 370:389-391 [1994].

Van De Kamer, J.H., "Total Fatty Acids in Stool," in Seligson (ed), Standard Methods of Clinical Chemistry, vol. 2, Academic Press, New York, NY, pp. 34-39 [1958].

Watson, M., et al., "Total nitrogen," in Peters et al. (eds.) Recommended Methods of Manure Analysis, Univ. of Wisconsin Cooperative Extension Publishing, Publication No. A3769., Madison, WI., p. 18-24 [2003].

Wells, J.A., et al., "Cassette mutagenesis: an efficient method for generation of multiple mutations at defined sites," Gene, 34:315-323 [1985].

Zhang, J-H., et al., "Directed evolution of a fucosidase from a galactosidase by DNA shuffling and screening," Proc. Nat. Acad. Sci., U.S.A., 94:4504-4509 [1997].

Zhao, H., et al., "Molecular evolution by staggered extension process (StEP) in vitro recombination," Nat. Biotechnol., 16:258-261 [1998].

\* cited by examiner

A.

B.

ENGINEERED PROTEASE VARIANTS

CROSS-REFERENCE TO RELATED APPLICATIONS

This application claims the benefit under 35 U.S.C. § 119(e) of U.S. provisional application No. 63/071,625, filed Aug. 28, 2020, the entire contents of which is incorporated herein by reference.

FIELD OF THE INVENTION

The present invention provides engineered protease polypeptides and compositions thereof. The engineered protease polypeptides have been optimized to provide improved activity, improved thermostability, protease stability, autolytic stability, and stability under a range of pH conditions, including acidic (pH<7) conditions. The invention also relates to the use of the compositions comprising the engineered protease polypeptides for therapeutic purposes. The present invention also provides polynucleotides encoding the engineered protease polypeptides, as well as methods for making the engineered polynucleotides and protease polypeptides.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX7-210US2_ST25.txt", a creation date of Aug. 27, 2021, and a size of about 9.07 megabytes. The Sequence Listing filed via EFS-Web is part of the specification and is incorporated in its entirety by reference herein.

BACKGROUND OF THE INVENTION

Pancreatic enzyme replacement therapy (PERT) finds use in the treatment of pancreatic enzyme insufficiency (PEI). Various disorders, including pancreatitis, cystic fibrosis, celiac disease, inflammatory bowel disease, and pancreatic cancer can lead to PEI, as a consequence of decreased secretion of pancreatic enzymes into the duodenum. This results in poor digestion of food, inadequate absorption of fat, proteins, carbohydrates, and vitamins by the intestines, which can lead to malnutrition. Although orally administered PERT treatments are currently available, the condition may not be alleviated in some people, due to insufficient activity of the PERT in the gastrointestinal tract and/or insufficient patient compliance with the therapy due to the significant pill burden associated with current treatment protocols. In some cases, the coefficient of fat absorption (CFA) and/or coefficient of nitrogen absorption (CNA) is inferior to that of healthy patients, resulting in weight loss and other health concerns. Thus, a need remains in the art for improved PERT treatments.

SUMMARY OF THE INVENTION

The present invention provides engineered protease polypeptides and compositions thereof. The engineered protease polypeptides have been optimized to provide improved activity, improved thermostability, protease stability, autolytic stability, and stability under a range of pH conditions, including acidic (pH<7) conditions. The invention also relates to the use of the compositions comprising the engineered protease polypeptides for therapeutic and/or nutritional purposes. The present invention also provides polynucleotides encoding the engineered lipase polypeptides, as well as methods for making the engineered polynucleotides and lipase polypeptides.

The present invention provides recombinant proteases and/or biologically active recombinant protease fragments comprising amino acid sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO: 2. In some embodiments, the recombinant protease and/or biologically active recombinant protease fragment comprises a polypeptide sequence having at least about 70%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

The present invention provides recombinant proteases and/or biologically active recombinant protease fragments comprising amino acid sequences comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the recombinant protease and/or biologically active recombinant protease fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises one or more substitutions at positions selected from 9, 17, 29, 30, 32, 34, 35, 36, 37, 43, 47, 50, 63, 75, 77, 81, 85, 92, 93, 107, 127, 132, 133, 135, 143, 145, 147, 162, 168, 187, 188, 189, 200, 205, 207, 208, 209, 210, 212, 220, 221, 222, 223, 225, 228, 236, 237, 238, 239, 241, 244, 245, 247, 257, 258, 260, 261, 262, 263, 265, 266, 283, 294, 300, 301, 307, 308, 318, 319, 334, 336, 339, 342, 344, 345, 346, 347, 355, 359, 361, 362, 363, 366, 368, 370, 373, 398, 404, 405, 406, 408, 412, 424, 427, 429, 431, 439, 441, 442, 446, 448, 449, 450, 454, 468, 470, 480, 481, 482, 485, 489, 490, 495, 497, 501, 504, 505, 506, 508, 511, 512, 514, 516, 523, 526, 527, 529, 533, 535, 536E, 537, 538, 539, 540, 541, 542, 543, 544, 545, 546, 547, 548, 549, 552, 553, 554, 555, 556, 558, 559, 560, 565, 566, 567, 568, 570, 571, 573, 575, 577, 580, 581, 582, 583, 586, 589, 591, 592, 594, 596, 599, 601, 604, 609, 610, 615, 616, 620, 631, 632, 634, 639, 643, 644, 645, 646, 647, 648A, 649, 650, 652, 653, 654, 659, 661, 662, 663, 664, 665, and 666, wherein the amino acid positions of the polypeptide sequence are numbered with reference to SEQ ID NO: 2.

In some additional embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set at one or more positions selected from 236, 258, 261, 339, 439, 446, and 454, wherein the amino acid positions of the polypeptide sequence are numbered with reference to SEQ ID NO: 2. In some further embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from 236V, 258K, 261L, 339M, 339W, 439M, 446A, 446G, 446L, 446M, 446T, and 454L, wherein the amino acid positions of the polypeptide sequence are numbered with reference to SEQ ID NO: 2. In some further embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from M236V, Q258K, E261L, N339M, N339W, S439M, P446A, P446G, P446L, P446M, P446T, and A454L, wherein the amino acid positions of the polypeptide sequence are numbered with reference to SEQ ID NO: 2.

In some additional embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set at one or more positions selected from 107/536, 162/408, 168/547, 208/366/504/591, 208/485/526, 210/223/258/552, 210/241/258/599, 223/241/258/599, 223/429/481/533, 223/481/533/552, 225, 225/260/263/265/544, 225/262, 225/362/366/591, 225/366, 225/482/591, 244, 258, 258/318/429, 258/449/481, 258/481, 261, 261/504, 318/481, 318/533, 318/599, 339, 342, 345, 362/366/485/591, 363, 366, 366/485, 366/497, 366/526/591, 366/591, 408, 427, 446, 448, 449, 450, 481/533/552, 482, 482/485, 482/591, 485, 485/591, 533, 533/552, 536, 544, 547, 549, 565, 615, and 652, wherein the amino acid positions of the polypeptide sequence are numbered with reference to SEQ ID NO: 2. In some further embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from 107T/536D, 162I/408R, 168N/547V, 208T/366G/504P/591L, 208T/485D/526L, 210D/223R/258K/552N, 210D/241P/258K/599L, 223R/241P/258K/599L, 223R/429L/481S/533K, 223R/481S/533K/552N, 225A/260D/263H/265R/544R, 225A/262L, 225A/362T/366G/591L, 225A/366G, 225A/482V/591L, 225K, 244K, 258K, 258K/318D/429L, 258K/449V/481S, 258K/481S, 258R, 261G, 261G/504V, 261L, 261R, 261S, 261V, 318D/481S, 318D/533K, 318D/599L, 339F, 339W, 342R, 345W, 362T/366G/485D/591L, 363E, 363W, 366A, 366G, 366G/485D, 366G/497R, 366G/526L/591L, 366G/591L, 366L, 366Q, 408R, 427H, 427R, 446R, 446V, 448K, 448R, 448W, 449K, 450W, 481S/533K/552N, 482V, 482V/485D, 482V/591L, 485D, 485D/591L, 533A, 533D, 533E, 533K, 533K/552N, 533N, 536E, 536G, 536V, 544R, 547A, 547E, 549T, 565C, 565D, 615A, 615D, 615G, 615P, 615T, 615W, and 652I, wherein the amino acid positions of the polypeptide sequence are numbered with reference to SEQ ID NO: 2. In some further embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from M107T/Q536D, T162I/A408R, S168N/Q547V, A208T/N366G/Q504P/K591L, A208T/N485D/R526L, N210D/N223R/Q258K/K552N, N210D/E241P/Q258K/D599L, N223R/E241P/Q258K/D599L, N223R/K429L/A481S/M533K, N223R/A481S/M533K/K552N, T225A/N260D/R263H/G265R/T544R, T225A/P262L, T225A/N362T/N366G/K591L, T225A/N366G, T225A/R482V/K591L, T225K, R244K, Q258K, Q258K/Q318D/K429L, Q258K/A449V/A481S, Q258K/A481S, Q258R, E261G, E261G/Q504V, E261L, E261R, E261S, E261V, Q318D/A481S, Q318D/M533K, Q318D/D599L, N339F, N339W, L342R, Q345W, N362T/N366G/N485D/K591L, Q363E, Q363W, N366A, N366G, N366G/N485D, N366G/Q497R, N366G/R526L/K591L, N366G/K591L, N366L, N366Q, A408R, P427H, P427R, P446R, P446V, N448K, N448R, N448W, A449K, N450W, A481S/M533K/K552N, R482V, R482V/N485D, R482V/K591L, N485D, N485D/K591L, M533A, M533D, M533E, M533K, M533K/K552N, M533N, Q536E, Q536G, Q536V, T544R, Q547A, Q547E, V549T, N565C, N565D, K615A, K615D, K615G, K615P, K615T, K615W, and K652I, wherein the amino acid positions of the polypeptide sequence are numbered with reference to SEQ ID NO: 2.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the recombinant protease comprises at least one substitution or substitution set at one or more positions selected from 258, 258/261/342/345, 258/261/342/504/533, 258/261/345/504/549, 258/261/482/504/549, 258/342, 258/342/504/533/536/549, 258/345/427, 258/408/427/504/549, 258/427, 258/427/482/504/533/536, 258/427/482/536, 261/342/345/536, 261/342/482/504/533/536, 261/342/482/504/549, 261/342/482/536, 261/342/533, 261/482, 318/339/362/544/547, 318/339/448/544, 318/339/547, 318/448/544/615, 339/362/363/544/547/615, 339/362/544, 339/448, 339/448/547, 339/544/547, 342, 342/408, 342/408/536, 342/482/536, 362/363/544/547, 362/448, 363/544/547, 427/482/504/533/536, 427/533/536/549, 448, 448/544, and 448/544/547/615, wherein the amino acid positions of the polypeptide sequence are numbered with reference to SEQ ID NO: 34. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the recombinant protease comprises at least one substitution or substitution set selected from 258K, 258K/261L/342R/345W, 258K/261L/342R/504P/533D, 258K/261L/345W/504P/549T, 258K/261R/482V/504P/549T, 258K/342R, 258K/342R/504P/533K/536E/549T, 258K/345W/427R, 258K/408R/427R/504P/549T, 258K/427R, 258K/427R/482V/504P/533K/536E, 258K/427R/482V/536E, 261L/342R/345W/536E, 261L/342R/482V/504P/533K/536E, 261L/342R/533D, 261R/342R/482V/504P/549T, 261R/342R/482V/536E, 261R/342R/482V, 318D/339W/362T/544R/547E, 318D/339W/448R/544R, 318D/339W/547E, 318D/448R/544R/615A, 339W/362T/363E/544R/547E/615A, 339W/362T/544R, 339W/448K, 339W/448R, 339W/448R/547E, 339W/544R/547E, 342R, 342R/408R, 342R/408R/536E, 342R/482V/536E, 362T/363E/544R/547E, 362T/448R, 363E/544R/547E, 427R/482V/504P/533D/536E, 427R/533K/536E/549T, 448R, 448R/544R, and 448R/544R/547E/615A, wherein the amino acid positions of the polypeptide sequence are numbered with reference to SEQ ID NO: 34. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the recombinant protease comprises at least one substitution or substitution set selected from Q258K, Q258K/E261L/L342R/Q345W, Q258K/E261L/L342R/Q504P/M533D, Q258K/E261L/Q345W/Q504P/V549T, Q258K/E261R/R482V/Q504P/V549T, Q258K/L342R, Q258K/L342R/Q504P/M533K/Q536E/V549T, Q258K/Q345W/P427R, Q258K/A408R/P427R/Q504P/V549T, Q258K/P427R, Q258K/P427R/R482V/Q504P/M533K/Q536E, Q258K/P427R/R482V/Q536E, E261L/L342R/Q345W/Q536E, E261L/L342R/R482V/Q504P/M533K/Q536E, E261L/L342R/M533D, E261R/L342R/R482V/Q504P/V549T, E261R/L342R/R482V/Q536E, E261R/R482V, Q318D/N339W/N362T/T544R/Q547E, Q318D/N339W/N448R/T544R, Q318D/N339W/Q547E, Q318D/N448R/T544R/K615A, N339W/N362T/Q363E/T544R/Q547E/K615A, N339W/N362T/T544R, N339W/N448K, N339W/N448R, N339W/N448R/Q547E, N339W/T544R/Q547E, L342R, L342R/A408R, L342R/A408R/Q536E, L342R/R482V/Q536E, N362T/Q363E/T544R/Q547E, N362T/N448R, Q363E/T544R/Q547E, P427R/R482V/Q504P/M533D/Q536E, P427R/M533K/Q536E/V549T, N448R, N448R/T544R, and N448R/T544R/Q547E/K615A, wherein the amino acid positions of the polypeptide sequence are numbered with reference to SEQ ID NO: 34.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set at one or more positions selected from 205, 505, 541, 556, and 646, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from 205Q, 205T, 505A, 541R, 556V, 646L, and 646V, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from S205Q, S205T, Q505A, S541R, T556V, A646L, and A646V, wherein the amino acid positions of the polypeptide sequence are numbered with reference to SEQ ID NO: 190.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set at one or more positions selected from 205, 220, 239, 261, 261/339, 261/339/547, 261/536, 261/536/547, 339/427/536, 339/427/536/547, 339/427/547, 405, 442, 505, 539, 541, 542, 545, 556, 558, 594, 631, 663, and 665, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from 205R, 220A, 239K, 261L, 261L/339S/547E, 261L/339W, 261L/536W, 261L/536W/547E, 339W/427R/536W, 339W/427R/536W/547E, 339W/427R/547E, 405R, 442L, 442S, 505G, 539*, 541G, 541I, 542*, 545*, 545I, 545R, 556*, 558E, 594A, 631W, 663*, 663M, and 665E, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from S205R, S220A, D239K, E261L, E261L/N339S/Q547E, E261L/N339W, E261L/Q536W, E261L/Q536W/Q547E, N339W/P427R/Q536W, N339W/P427R/Q536W/Q547E, N339W/P427R/Q547E, V405R, V442L, V442S, Q505G, P539*, S541G, S541I, I542*, A545*, A545I, A545R, T556*, T558E, V594A, G631W, E663*, E663M, and P665E, wherein the amino acid positions of the polypeptide sequence are numbered with reference to SEQ ID NO: 190.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the recombinant protease comprises at least one substitution or substitution set at one or more positions selected from 205/442/505/536/545/620/646, 205/505/536/541/545/547/558/646/665, 258, 263, 355/536/545/547, 359, 366, 446, 449, 505/536/545/558/646, 506, 555, 556, 620, and 650, wherein the amino acid positions of the polypeptide sequence are numbered with reference to SEQ ID NO: 292. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the recombinant protease comprises at least one substitution or substitution set selected from 205R/442L/505A/536W/545E620V/646V, 205R/505A/536W/541E545R/547E/558E/646V/665E, 258G, 263M, 263S, 355R/536W/545E547E, 359Y, 366S, 446P, 449L, 505A/536W/545E558E/646V, 506R, 555D, 555G, 555L, 556G, 620L, 620Q, 620S, and 650T, wherein the amino acid positions of the polypeptide sequence are numbered with reference to SEQ ID NO: 292. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the recombinant protease comprises at least one substitution or substitution set selected from S205R/V442L/Q505A/Q536W/A545I/E620V/A646V, S205R/Q505A/Q536W/S541I/A545R/Q547E/T558E/ A646V/P665E, K258G, R263M, R263S, L355R/Q536W/ A545I/Q547E, F359Y, N366S, R446P, A449L, Q505A/ Q536W/A545I/T558E/A646V, G506R, E555D, E555G, E555L, T556G, E620L, E620Q, E620S, and I650T, wherein the amino acid positions of the polypeptide sequence are numbered with reference to SEQ ID NO: 292.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the recombinant protease comprises at least one substitution or substitution set at one or more positions selected from 283/319/359/449/450/506, 283/345/359/449/ 450/553/555, 283/449/450/508/541/553/555, 449/450, 450/ 508/553/555/558, 508, and 508/541/553, wherein the amino acid positions of the polypeptide sequence are numbered with reference to SEQ ID NO: 342. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the recombinant protease comprises at least one substitution or substitution set selected from 283H/345C/359Y/449L/450R/553T/555G, 283L/319K/359Y/449L/450R/506R, 283L/449L/450R/ 508G/541E553T/555G, 449L/450R, 450R/508G/553R/ 555G/558E, 508G, and 508G/541I/553T, wherein the amino acid positions of the polypeptide sequence are numbered with reference to SEQ ID NO: 342. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the recombinant protease comprises at least one substitution or substitution set selected from N283H/Q345C/F359Y/A449L/N450R/ D553T/E555G, N283L/N319K/F359Y/A449L/N450R/ G506R, N283L/A449L/N450R/N508G/S541I/D553T/ E555G, A449L/N450R, N450R/N508G/D553R/E555G/ T558E, N508G, and N508G/S541I/D553T, wherein the amino acid positions of the polypeptide sequence are numbered with reference to SEQ ID NO: 342.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the recombinant protease comprises at least one substitution or substitution set at one or more positions selected from 205, 205/442/449/450, 205/450/536/545, 205/ 450/536/545/646, 258/442/446, 258/442/449/646, 258/450/ 536/545, 308, 361, 439, 442/446/536/545/620/646, 442/450/ 536/545, 514, 535, 577, 591, 592, 610, 639, 643, and 644, wherein the amino acid positions of the polypeptide sequence are numbered with reference to SEQ ID NO: 396 or 1366. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the recombinant protease comprises at least one substitution or substitution set selected from 205S, 205S/442V/449A/450N, 205S/450N/536Q/545A, 205S/ 450N/536Q/545A/646A, 258Q/442V/446P, 258Q/442V/ 449A/646A, 258Q/450N/536Q/545A, 308E, 361V, 439M, 442V/446P/536Q/545A/620E/646A, 442V/450N/536Q/ 545A, 514H, 535R, 535V, 577V, 591R, 591V, 592P, 610L, 610P, 610S, 639E, 639K, 643E, 643R, and 644A, wherein the amino acid positions of the polypeptide sequence are numbered with reference to SEQ ID NO: 396 or 1366. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the recombinant protease comprises at least one substitution or substitution set selected from R205S, R205S/ L442V/L449A/R450N, R205S/R450N/W536Q/I545A, R205S/R450N/W536Q/I545A/V646A, K258Q/L442V/ R446P, K258Q/L442V/L449A/V646A, K258Q/R450N/ W536Q/I545A, A308E, I361V, S439M, L442V/R446P/ W536Q/I545A/V620E/V646A, L442V/R450N/W536Q/ I545A, R514H, E535R, E535V, D577V, K591R, K591V, A592P, A610L, A610P, A610S, A639E, A639K, A643E, A643R, and D644A, wherein the amino acid positions of the polypeptide sequence are numbered with reference to SEQ ID NO: 396 or 1366.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 400 or 1370, or a functional fragment thereof, and wherein the recombinant protease comprises at least one substitution or substitution set at one or more positions selected from 32/490/639, 236, 236/238/404/480/555/568/ 592, 236/359/404/406/555/639, 236/359/490/581/639, 236/ 359/555, 236/359/609, 236/370/406/568/581, 236/370/568/ 592, 236/370/581, 236/404/406/480/490, 236/404/555/581/ 609/639, 236/568, 236/592, 236/639, 238/359/370/404/490/ 568/639, 245/363/408/512/514/596/666, 245/363/512/514/ 537/560, 308/514/535/639/644, 359/404, 359/404/406/490/ 546/581, 363/408/512/514/537, 363/408/601/650, 363/639/ 644, 408/512, 408/514/537, 408/514/560/650, 490/568/592/ 639, 512/537/560/601, 514/535/546/575/644, 514/639/644, 514/644, 535/575/639/644, 535/639/643/644, 535/643/644, and 601/650, wherein the amino acid positions of the polypeptide sequence are numbered with reference to SEQ ID NO: 400 or 1370. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 400 or 1370, or a functional fragment thereof, and wherein the recombinant protease comprises at least one substitution or substitution set selected from 32T/490E/639T, 236V, 236V/238I/404G/ 480L/555Q/568P/592P, 236V/359Y/404G/406R/555Q/ 639T, 236V/359Y/490E/581T/639T, 236V/359Y/555Q, 236V/359Y/609G, 236V/370C/406R/568P/581T, 236V/ 370C/568P/592P, 236V/370C/581T, 236V/404G/406R/ 480L/490E, 236V/404G/555Q/581T/609G/639T, 236V/ 568P, 236V/592P, 236V/639T, 238I/359Y/370C/404G/ 490E/568P/639T, 245S/363K/408V/512N/514H/596T/ 666D, 245S/363K/512N/514H/537P/560S, 308E/514H/

535R/639K/644A, 359Y/404G, 359Y/404G/406R/490E/
546E/581T, 363H/639K/644A, 363K/408V/512N/514H/
537P, 363K/408V/601E650T, 408V/512N, 408V/514H/
537P, 408V/514H/560S/650T, 490E/568P/592P/639T,
512N/537P/560S/601I, 514H/535R/546E/575G/644A,
514H/639K/644A, 514H/644A, 535R/575G/639K/644A,
535R/639K/643R/644A, 535V/643R/644A, and 601I/650T,
wherein the amino acid positions of the polypeptide
sequence are numbered with reference to SEQ ID NO: 400
or 1370. In some further embodiments, the recombinant
protease comprises a polypeptide sequence having at least
80%, 85%, 86%, 87%, 88%, 89%, 90%, 91%, 92%, 93%,
94%, 95%, 96%, 97%, 98%, 99%, or more sequence identity
to SEQ ID NO: 400 or 1370, or a functional fragment
thereof, and wherein the recombinant protease comprises at
least one substitution or substitution set selected from I32T/
Q490E/A639T, M236V, M236V/L238I/S404G/I480L/
E555Q/L568I7A592P, M236V/F359Y/S404G/K406R/
E555Q/A639T, M236V/F359Y/Q490E/S581T/A639T,
M236V/F359Y/E555Q, M236V/F359Y/A609G, M236V/
S370C/K406R/L568P/S581T, M236V/S370C/L568P/
A592P, M236V/S370C/S581T, M236V/S404G/K406R/
I480L/Q490E, M236V/S404G/E555Q/S581T/A609G/
A639T, M236V/L568P, M236V/A592P, M236V/A639T,
L238I/F359Y/S370C/S404G/Q490E/L568P/A639T,
T245S/Q363K/A408V/S512N/R514H/M596T/S666D,
T245S/Q363K/S512N/R514H/E537P/T560S, A308E/
R514H/E535R/A639K/D644A, F359Y/S404G, F359Y/
S404G/K406R/Q490E/V546E/S581T, Q363H/A639K/
D644A, Q363K/A408V/S512N/R514H/E537P, Q363K/
A408V/M601I/I650T, A408V/S512N, A408V/R514H/
E537P, A408V/R514H/T560S/I650T, Q490E/L568P/
A592P/A639T, S512N/E537P/T560S/M601I, R514H/
E535R/V546E/S575G/D644A, R514H/A639K/D644A,
R514H/D644A, E535R/S575G/A639K/D644A, E535R/
A639K/A643R/D644A, E535V/A643R/D644A, and
M601I/I650T, wherein the amino acid positions of the
polypeptide sequence are numbered with reference to SEQ
ID NO: 400 or 1370.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 454 or 1424, or a functional fragment thereof, and wherein the recombinant protease comprises at least one substitution or substitution set at one or more positions selected from 236, 236/308/370/548, 236/308/490/581/643, 236/308/555/560/596, 236/370, 236/370/490/639, 236/555, 236/560/581, 245/359/363/406/535/650, 245/363/406/575/601/666, 300, 301, 308, 308/490/560/581/639/643, 336, 359/363/406/535/601/650, 359/404/406/535, 359/406/575/650/666, 359/535/575/601, 363/404/406/535/568, 404/406/535, 406, 406/480/535/568/601, 406/535/575, 468, and 480/575/601/650, wherein the amino acid positions of the polypeptide sequence are numbered with reference to SEQ ID NO: 454 or 1424. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 454 or 1424, or a functional fragment thereof, and wherein the recombinant protease comprises at least one substitution or substitution set selected from 236V, 236V/308E/370C/548E, 236V/308E/490E/581T/643R, 236V/308E/555Q/560S/596T, 236V/370C, 236V/370C/490E/639T, 236V/555Q, 236V/560S/581T, 245S/359Y/363K/406R/535R/650T, 245S/363K/406R/575G/601I/666D, 300F, 301V, 308E, 308E/
490E/560S/581T/639T/643R, 336W, 359Y/363K/406R/
535R/601I/650T, 359Y/404G/406R/535R, 359Y/406R/
575G/650T/666D, 359Y/535R/575G/601I, 363K/404G/
406R/535R/568P, 404G/406R/535R, 406R, 406R/480L/
535R/568P/601I, 406R/535R/575G, 468S, and 480L/575G/
601I/650T, wherein the amino acid positions of the
polypeptide sequence are numbered with reference to SEQ
ID NO: 454 or 1424. In some further embodiments, the
recombinant protease comprises a polypeptide sequence
having at least 80%, 85%, 86%, 87%, 88%, 89%, 90%, 91%,
92%, 93%, 94%, 95%, 96%, 97%, 98%, 99%, or more
sequence identity to SEQ ID NO: 454 or 1424, or a
functional fragment thereof, and wherein the recombinant
protease comprises at least one substitution or substitution
set selected from M236V, M236V/A308E/S370C/D548E,
M236V/A308E/Q490E/S581T/A643R, M236V/A308E/
E555Q/T560S/M596T, M236V/S370C, M236V/S370C/
Q490E/A639T, M236V/E555Q, M236V/T560S/S581T,
T245S/F359Y/Q363K/K406R/E535R/I650T, T245S/
Q363K/K406R/S575G/M601I/S666D, L300F, A301V,
A308E, A308E/Q490E/T560S/S581T/A639T/A643R,
Y336W, F359Y/Q363K/K406R/E535R/M601I/I650T,
F359Y/S404G/K406R/E535R, F359Y/K406R/S575G/
I650T/S666D, F359Y/E535R/S575G/M601I, Q363K/
S404G/K406R/E535R/L568P, S404G/K406R/E535R,
K406R, K406R/I480L/E535R/L568P/M601I, K406R/
E535R/S575G, A468S, and I480L/S575G/M601I/I650T,
wherein the amino acid positions of the polypeptide
sequence are numbered with reference to SEQ ID NO: 454
or 1424.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set at one or more positions selected from 133/301/346/347/468, 205/236/347, 205/236/370/490/537/620, 205/342/439/442/514/620/639, 205/370/537, 205/442/505/620, 236/258/370/505/545/639, 236/339/514, 236/370/450/620, 236/545, 258/339/342/505/537, 258/342/370/408/442/537, 300/301/308/346/347/468, 300/301/347/468, 301/308/336/346/406/468/601, 301/308/346/406/468, 301/308/468/601, 301/347/406, 308/336/347/468, 308/347/468, 342, 342/408/490/505/514/545/639/646, 342/620, 370/442, 370/537/639, 489, 539/649, 542, 543, 543/673, 558, 559, 566, 634, and 661, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from 133M/301V/346K/347F/468S, 205S/236M/347F, 205S/236M/370S/490Q/537E/620E, 205S/342L/439S/442V/514R/620E/639A, 205S/370S/537E, 205S/442V/505Q/620E, 236M/258Q/370S/505Q/545A/639A, 236M/339N/514R, 236M/370S/450N/620E, 236M/545A, 258Q/339N/342L/505Q/537E, 258Q/342L/370S/408A/442V/537E, 300F/301V/308E/346K/347F/468S, 300F/301V/347F/468S, 301V/308E/336W/346K/406R/468S/601I, 301V/308E/346K/406R/468S, 301V/308E/468S/601I, 301V/347F/406R, 308E/336W/347F/468S, 308E/347F/468S, 342L, 342L/408A/490Q/505Q/514R/545A/639A/646A, 342L/620E, 370S/442V, 370S/537E/639A, 489Y, 539M/649H, 542M, 543A, 543V/ 673Y, 558R, 559H, 559S, 566G, 634C, and 661D, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from L133M/ A301V/V346K/V347F/A468S, R205S/V236M/V347F, R205S/V236M/C370S/E490Q/P537E/V620E, R205S/ R342L/M439S/L442V/H514R/V620E/T639A, R205S/ C370S/P537E, R205S/L442V/A505Q/V620E, V236M/ K258Q/C370S/A505Q/I545A/T639A, V236M/W339N/ H514R, V236M/C370S/R450N/V620E, V236M/I545A, K258Q/W339N/R342L/A505Q/P537E, K258Q/R342L/ C370S/V408A/L442V/P537E, L300F/A301V/A308E/ V346K/V347F/A468S, L300F/A301V/V347F/A468S, A301V/A308E/Y336W/V346K/K406R/A468S/M601I, A301V/A308E/V346K/K406R/A468S, A301V/A308E/ A468S/M601I, A301V/V347F/K406R, A308E/Y336W/ V347F/A468S, A308E/V347F/A468S, R342L, R342L/ V408A/E490Q/A505Q/H514R/I545A/T639A/V646A, R342L/V620E, C370S/L442V, C370S/P537E/T639A, D489Y, P539M/D649H, I542M, F543A, F543V/H673Y, T558R, L559H, L559S, T566G, P634C, and G661D, wherein the amino acid positions of the polypeptide sequence are numbered with reference to SEQ ID NO: 562 or 1532.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set at one or more positions selected from 205/236/342/439/505/514/537/545, 236/342/ 505/514/537/545, 300/301/308/336/347/468/601, 300/301/ 347/406, 301/308/346/347/468, 301/336/346/347/406/601, and 308/336/347/406/468/601, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from 205S/236M/342L/439S/505Q/514R/537E/ 545A, 236M/342L/505Q/514R/537E/545A, 300F/301V/ 308E/336W/347F/468S/601I, 300F/301V/347F/406R, 301V/308E/346K/347F/468S, 301V/336W/346K/347F/ 406R/601I, and 308E/336W/347F/406R/468S/601I, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from R205S/V236M/R342L/M439S/A505Q/H514R/P537E/ I545A, V236M/R342L/A505Q/H514R/P537E/I545A, L300F/A301V/A308E/Y336W/V347F/A468S/M601I, L300F/A301V/V347F/K406R, A301V/A308E/V346K/ V347F/A468S, A301V/Y336W/V346K/V347F/K406R/ M601I, and A308E/Y336W/V347F/K406R/A468S/M601I, wherein the amino acid positions of the polypeptide sequence are numbered with reference to SEQ ID NO: 562 or 1532.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set at one or more positions selected from 346/511/537, 346/511/537/541/543, 346/511/ 542/582, 346/511/581/582, 346/511/583, 346/529/571/581/ 582/583/589, 511/537, 516/539/568, 537/582, 539, 568/662/ 663, and 581/582, wherein the amino acid positions of the polypeptide sequence are numbered with reference to SEQ ID NO: 638. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from 346V/ 511S/537E, 346V/51 IS/537E/541I/543G, 346V/511S/ 542S/582R, 346V/511S/581L/582R, 346V/511S/583R, 346V/529G/571I/581C/582V/583V/589A, 511S/537E, 516M/539E/568R, 537E/582R, 539E, 568R/662W/663W, and 581L/582R, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from K346V/A511S/P537E, K346V/A511S/ P537E/S541I/F543G, K346V/A511S/I542S/Y582R, K346V/A511S/S581L/Y582R, K346V/A511S/I583R, K346V/V529G/S571I/S581C/Y582V/I583V/T589A, A511S/P537E, P516M/P539E/L568R, P537E/Y582R, P539E, L568R/F662W/E663W, and S581L/Y582R, wherein the amino acid positions of the polypeptide sequence are numbered with reference to SEQ ID NO: 638 or 1608.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set at one or more positions selected from 346/511/537/582, 346/511/543/582, 346/511/ 544, 346/537/542/544, 346/543/544, 346/583, 511/537/542/ 582/583, 516, 516/539/555, 537/543/582, 539/568, 540, 542/544/581, 548, 549, 559, 559/568, 582, 647, 650, and 664, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from 346V/

511S/537E/582V, 346V/511S/543G/582R, 346V/511S/ 544L, 346V/537E/542S/544L, 346V/543G/544L, 346V/ 583R, 511S/537E/542S/582R/583R, 516M, 516M/539E/ 555G, 537E/543G/582R, 539E/568R, 540G, 542S/544L/ 581R, 548R, 549G, 559S, 559S/568R, 582V, 647L, 647W, 650G, and 664R, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from K346V/A511S/P537E/Y582V, K346V/ A511S/F543G/Y582R, K346V/A511S/T544L, K346V/ P537E/I542S/T544L, K346V/F543G/T544L, K346V/ I583R, A511S/P537E/I542S/Y582R/I583R, P516M, P516M/P539E/E555G, P537E/F543G/Y582R, P539E/ F568R, V540G, I542S/T544F/S581R, D548R, V549G, F559S, F559S/F568R, Y582V, Q647F, Q647W, I650G, and Q664R, wherein the amino acid positions of the polypeptide sequence are numbered with reference to SEQ ID NO: 638 or 1608.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680 or 1650, or a functional fragment thereof, and wherein the recombinant protease comprises at least one substitution or substitution set at one or more positions selected from 261/355/543, 261/355/567/568, 261/489, 261/ 489/511/568, 261/489/539, 261/489/567, 261/539/543, 261/ 539/543/567, 261/542/543/568, 511, 511/539/543, 511/567, 543, and 583, wherein the amino acid positions of the polypeptide sequence are numbered with reference to SEQ ID NO: 680 or 1650. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680 or 1650, or a functional fragment thereof, and wherein the recombinant protease comprises at least one substitution or substitution set selected from 261D/355C/543A, 261D/355C/567R/ 568R, 261D/489E, 261D/489E/511D/568R, 261D/489E/ 539L, 261D/489E/567R, 261D/539L/543A, 261D/539L/ 543D/567R, 261D/542L/543A/568R, 511D, 511D/539L/ 543A, 511D/567R, 543A, and 583E, wherein the amino acid positions of the polypeptide sequence are numbered with reference to SEQ ID NO: 680 or 1650. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680 or 1650, or a functional fragment thereof, and wherein the recombinant protease comprises at least one substitution or substitution set selected from L261D/L355C/F543A, L261D/L355C/D567R/L568R, L261D/D489E, L261D/ D489E/A511D/L568R, L261D/D489E/P539L, L261D/ D489E/D567R, L261D/P539L/F543A, L261D/P539L/ F543D/D567R, L261D/I542L/F543A/L568R, A511D, A511D/P539L/F543A, A511D/D567R, F543A, and I583E, wherein the amino acid positions of the polypeptide sequence are numbered with reference to SEQ ID NO: 680 or 1650.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set at one or more positions selected from 9, 9/17/34/35/93/554, 9/17/50, 9/17/93, 9/29/ 35/43/77/542/554, 9/32/77/93, 9/43/77, 9/50/63/93, 9/93, 17/29/34/35/36/77/93, 17/32/34/35, 17/77, 32/34/93, 43, 50/77/93, 50/93, 77/93, 93, 205/263/470, 205/344/470/565, 205/345/470/538/664, 205/470/545/568/645/647/664, 205/ 470/567/568/645, 263/344/664, 263/470/645, 263/489, 263/ 539/541/568/645, 344/355/470/489/645, 344/355/470/568/ 645/647, 344/470/489/539/542/645/647/664, 344/470/489/ 567/568, 344/470/568, 344/470/647, 470, 470/489, 470/541/ 542/543/565/645/647, 470/567/568, 470/664, and 542/543, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from 9K, 9K/17A/34M/35G/93E/554M, 9K/17A/50S, 9K/17A/93E, 9K/29S/35G/43P/77D/542V/554M, 9K/32A/77D/93E, 9K/43P/77D, 9K/50S/63E/93E, 9K/93E, 9Q/17A/93E, 17A/ 29S/34M/35G/36D/77D/93E, 17A/32A/34M/35G, 17A/ 77D, 32A/34M/93E, 43P, 50S/77D/93E, 50S/93E, 77D/93E, 93E, 205L/263V/470Q, 205L/344V/470Q/565A, 205L/ 345P/470Q/538T/664R, 205L/470Q/545L/568R/645S/ 647W/664R, 205L/470Q/567R/568R/645S, 263I/344V/ 664R, 263E470Q/645S, 263I/489D, 263I/539L/541R/568R/ 645S, 344V/355C/470Q/489D/645S, 344V/355C/470Q/ 568R/645S/647W, 344V/470Q/489D/539L/542L/645S/ 647W/664R, 344V/470Q/489D/567R/568R, 344V/470Q/ 568R, 344V/470Q/647W, 470Q, 470Q/489D, 470Q/541R/ 542L/543A/565A/645S/647W, 470Q/567R/568R, 470Q/ 664R, and 542L/543A, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from R9K, R9K/T17A/T34M/E35G/A93E/ L554M, R9K/T17A/N50S, R9K/T17A/A93E, R9K/N29S/ E35G/S43P/N77D/I542V/L554M, R9K/I32A/N77D/A93E, R9K/S43P/N77D, R9K/N50S/A63E/A93E, R9K/A93E, R9Q/T17A/A93E, T17A/N29S/T34M/E35G/T36D/N77D/ A93E, T17A/I32A/T34M/E35G, T17A/N77D, I32A/T34M/ A93E, S43P, N50S/N77D/A93E, N50S/A93E, N77D/A93E, A93E, R205L/R263V/P470Q, R205L/N344V/P470Q/ N565A, R205L/Q345P/P470Q/S538T/Q664R, R205L/ P470Q/I545L/L568R/K645S/Q647W/Q664R, R205L/ P470Q/D567R/L568R/K645S, R263I/N344V/Q664R, R263I/P470Q/K645S, R263I/E489D, R263I/P539L/S541R/ L568R/K645S, N344V/L355C/P470Q/E489D/K645S, N344V/L355C/P470Q/L568R/K645S/Q647W, N344V/ P470Q/E489D/P539L/I542L/K645S/Q647W/Q664R, N344V/P470Q/E489D/D567R/L568R, N344V/P470Q/ L568R, N344V/P470Q/Q647W, P470Q, P470Q/E489D, P470Q/S541R/I542L/F543A/N565A/K645S/Q647W, P470Q/D567R/L568R, P470Q/Q664R, and I542L/F543A, wherein the amino acid positions of the polypeptide sequence are numbered with reference to SEQ ID NO: 756 or 1726.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set at one or more positions selected from 9/17/32/34/36/50/77/107/127, 9/17/63/77, 9/43/93/127, 9/63/93/107, 17/29/32/34/36/63, 29/34/35/77, 32/43/93, 35/93/145, and 205/263/489/647, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from 9K/17A/32A/34M/36D/50S/77D/107K/127S, 9K/17A/63E/77D, 9K/43P/93E/127S, 9K/63E/93E/107K, 17A/29S/32A/34M/36D/63E, 29S/34M/35G/77D, 32A/43P/93E, 35G/93E/145E, and 205L/263V/489D/647W, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from R9K/T17A/I32A/T34M/T36D/N50S/N77D/M107K/G127S, R9K/T17A/A63E/N77D, R9K/S43P/A93E/G127S, R9K/A63E/A93E/M107K, T17A/N29S/I32A/T34M/T36D/A63E, N29S/T34M/E35G/N77D, I32A/S43P/A93E, E35G/A93E/G145E, and R205L/R263V/E489D/Q647W, wherein the amino acid positions of the polypeptide sequence are numbered with reference to SEQ ID NO: 756 or 1726.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 188, 189, 265, 266, 334, 442, 454, 646, and 649, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812, or a functional fragment thereof, and wherein the recombinant protease comprises at least one substitution or substitution set selected from 188W, 189A, 189P, 265R, 266E, 266G, 334I, 442V, 454L, 454M, 454S, 646I, 646M, 646R, 649T, and 649Y, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from N188W, K189A, K189P, G265R, N266E, N266G, V334I, L442V, A454L, A454M, A454S, V646I, V646M, V646R, D649T, and D649Y, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 189, 266, 266/283, 546, 594, and 646, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812, or a functional fragment thereof, and wherein the recombinant protease comprises at least one substitution or substitution set selected from 189I, 266A, 266L, 266L/283K, 266M, 266S, 266V, 266W, 266Y, 546L, 594A, and 646L, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from K189I, N266A, N266L, N266L/N283K, N266M, N266S, N266V, N266W, N266Y, V546L, V594A, and V646L, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 263/470/568, 266, 470/542/543/664, and 558/577/594, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from 263I/470P/568R, 266R, 470P/542L/543A/664Q, and 558E/577V/594A, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from R263I/Q470P/L568R, N266R, Q470P/I542L/F543A/ R664Q, and T558E/D577V/V594A, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 29, 29/35, 29/35/342/581/582/664, 29/50/511/ 539/581, 35, 35/50/205/406/511/581, 35/205/511, 35/342/ 346/511/539/581, 35/346, 35/346/406/511/581/582/664, 35/511, 35/539, 50/342, 132, 133, 143, 147, 187, 188, 257, 258, 263, 294, 294/441/527, 308/342/511/581/582, 342, 346, 398, 406/664, 429/652, 441, 441/446/526, 446/652, 482, 505, 511, 526, 527, 536, 545, 581, 582, 615, 620, 639, 645, 646, 648, 652, 654, and 664, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from 29F, 29G, 29S/35G, 29S/35G/ 342L/581S/582Y/664Q, 29S/50S/511S/539L/581S, 35D/ 511S, 35G, 35G/50S/205S/406R/511S/581S, 35G/205S/ 511S, 35G/342L/346V/511S/539L/581S, 35G/346V, 35G/ 346V/406R/511S/581S/582Y/664Q, 35G/511S, 35G/539L, 50S/342L, 132T, 133V, 143H, 147T, 187G, 188T, 257L, 258H, 258N, 263S, 294A, 294A/441A/527A, 308A/342L/ 511S/581S/582Y, 342F, 346V, 398G, 406R/664Q, 429L/ 652T, 441A, 441A/446P/526L, 441V, 446P/652T, 482V, 505F, 505M, 51 IS, 526V, 527D, 527R, 536H, 536R, 545V, 581A, 581S, 582G, 582S, 582Y, 615Q, 620E, 639E, 639I, 645E, 645G, 645W, 646G, 646R, 648Q, 648V, 652L, 652Q, 652T, 652Y, 654C, 664G, 664V, and 664W, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from N29F, N29G, N29S/E35G, N29S/E35G/R342L/L581S/R582Y/R664Q, N29S/N50S/ A511S/P539L/L581S, E35D/A511S, E35G, E35G/N50S/ R205S/K406R/A511S/L581S, E35G/R205S/A511S, E35G/ R342L/K346V/A511S/P539L/L581S, E35G/K346V, E35G/ K346V/K406R/A511S/L581S/R582Y/R664Q, E35G/ A511S, E35G/P539L, N50S/R342L, I132T, L133V, E143H, A147T, I187G, N188T, R257L, K258H, K258N, R263S, R294A, R294A/R441A/K527A, E308A/R342L/A511S/ L581S/R582Y, R342F, K346V, A398G, K406R/R664Q, K429L/K652T, R441A, R441A/R446P/R526L, R441V, R446P/K652T, R482V, A505F, A505M, A511S, R526V, K527D, K527R, W536H, W536R, I545V, L581A, L581S, R582G, R582S, R582Y, K615Q, V620E, T639E, T639I, K645E, K645G, K645W, V646G, V646R, R648Q, R648V, K652L, K652Q, K652T, K652Y, R654C, R664G, R664V, and R664W, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the recombinant protease comprises at least one substitution or substitution set at one or more positions selected from 29, 29/143/263/266/441/639, 29/263/266, 29/263/266/441/620, 29/266/441, 29/441/639, 30, 37, 47/570, 75, 81, 85, 92, 135, 143, 143/263/266/639, 143/266/ 441/620/639, 168, 189/424, 237/527, 244, 258/342/582/648, 263, 263/266/441, 263/266/639, 266/441, 266/441/620/639, 266/620/639, 266/639, 267, 342/526/664, 342/545, 342/582, 429, 441, 482, 495, 501, 523, 526, 527, 568, 570, 573, 581, 582, 616, 632, 648, 653, and 654, wherein the amino acid positions of the polypeptide sequence are numbered with reference to SEQ ID NO: 1030 or 2000. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the recombinant protease comprises at least one substitution or substitution set selected from 29G/143H/263S/266A/441V/ 639I, 29G/263S/266A, 29G/263S/266L/441A/620E, 29G/ 266A/441A, 29G/441V/639V, 29S, 30G, 37L, 47G/570E, 75N, 75S, 81N, 85L, 92L, 135E, 143H/263S/266A/639V, 143H/266A/441V/620E/639V, 143Q, 168E, 189Q/424G, 237E/527V, 244S, 258H/342F/582S/648Q, 263S/266A/ 441A, 263S/266A/441V, 263S/266A/639V, 263T, 266A/ 441V/620E/639V, 266A/620E/639I, 266A/639I, 266L/ 441A, 267G, 342F/526V/664G, 342F/545V, 342F/582G, 429P, 441E, 482V, 495L, 501Q, 523V, 526E, 527E, 527L, 527M, 527R, 527T, 568P, 570E, 573T, 581T, 582F, 616T, 632Q, 648A, 653I, and 654V, wherein the amino acid positions of the polypeptide sequence are numbered with reference to SEQ ID NO: 1030 or 2000. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the recombinant protease comprises at least one substitution or substitution set selected from N29G/E143H/R263S/N266A/ R441V/T639I, N29G/R263S/N266A, N29G/R263S/ N266L/R441A/V620E, N29G/N266A/R441A, N29G/ R441V/T639V, N29S, R30G, R37L, E47G/K570E, R75N, R75S, R81N, R85L, P92L, R135E, E143H/R263S/N266A/ T639V, E143H/N266A/R441V/V620E/T639V, E143Q, S168E, K189Q/D424G, D237E/K527V, R244S, K258H/ L342F/R582S/R648Q, R263S/N266A/R441A, R263S/ N266A/R441V, R263S/N266A/T639V, R263T, N266A/ R441V/V620E/T639V, N266A/V620E/T639I, N266A/ T639I, N266L/R441A, R267G, L342F/R526V/R664G, L342F/I545V, L342F/R582G, K429P, R441E, R482V, I495L, R501Q, M523V, R526E, K527E, K527L, K527M, K527R, K527T, L568P, K570E, K573T, S581T, R582F, K616T, K632Q, R648A, M653I, and R654V, wherein the amino acid positions of the polypeptide sequence are numbered with reference to SEQ ID NO: 1030 or 2000.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set at one or more positions selected from 29, 29/30, 29/30/143/263/482/646, 29/30/263, 29/30/616/648, 29/75/263/568/570/648, 29/168/648, 29/263/527/568, 75, 75/143/168/527, 75/168, 75/616, 143, 168/247/482/648, 168/263/616, 168/482/616, 168/495/616, 263, 263/616, 429/545, 495, and 527, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from 29S, 29S/30G, 29S/30G/ 143Q/263T/482V/646E, 29S/30G/263T, 29S/30G/616T/ 648A, 29S/75S/263T/568P/570E/648A, 29S/168E/648A, 29S/263T/527L/568P, 75S, 75S/143Q/168E/527L, 75S/ 168E, 75S/616T, 143Q, 168E/247S/482V/648A, 168E/ 263T/616T, 168E/482V/616T, 168E/495L/616T, 263T, 263T/616T, 429P/545V, 495L, and 527T, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from N29S, N29S/R30G, N29S/ R30G/E143Q/S263T/R482V/V646E, N29S/R30G/S263T, N29S/R30G/K616T/R648A, N29S/R75S/S263T/L568P/ K570E/R648A, N29S/S168E/R648A, N29S/S263T/K527L/ L568P, R75S, R75S/E143Q/S168E/K527L, R75S/S168E, R75S/K616T, E143Q, S168E/G247S/R482V/R648A, S168E/S263T/K616T, S168E/R482V/K616T, S168E/ I495L/K616T, S263T, S263T/K616T, K429P/I545V, I495L, and K527T, wherein the amino acid positions of the polypeptide sequence are numbered with reference to SEQ ID NO: 1136 or 2106.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set at one or more positions selected from 207, 222, 266, 307, 454, 535, 546, 548, 580, 604, and 610, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from 207R, 222T, 266K, 307L, 454L, 535V, 546R, 548S, 580C, 604P, and 610R, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from Q207R, S222T, A266K, Q307L, A454L, E535V, V546R, D548S, H580C, H604P, and A610R, wherein the amino acid positions of the polypeptide sequence are numbered with reference to SEQ ID NO: 1136 or 2106.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the recombinant protease comprises at least one substitution or substitution set at one or more positions selected from 75/168/207/454/568/586/610/648/659, 75/168/266/454/546/570/580, 75/207/454/570/659, 75/207/ 546/580/648, 75/263/454/548/568/604/648, 75/266/454, 75/454, 75/454/546/548/568/604, 75/546/548/610/648, 168/ 207/263/454/568/570/604, 168/263/266/546/604, 168/454/ 604, 207/604/610, 209, 212, 221, 223, 228, 266/454/568, 319, 373, 412/546/554, 431, 454, 454/546/568/570/580, 454/546/570, 454/570/580/610, 454/580, 454/659, and 506, wherein the amino acid positions of the polypeptide sequence are numbered with reference to SEQ ID NO: 1180 or 2150. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the recombinant protease comprises at least one substitution or substitution set selected from 75S/ 168E/207R/454L/568P/586V/610R/648A/659T, 75S/168E/ 266K/454L/546R/570E/580C, 75S/207R/454L/570E/659T, 75S/207R/546R/580C/648A, 75S/263T/454L/548S/568P/ 604P/648A, 75S/266K/454L, 75S/454L, 75S/454L/546R/ 548S/568P/604P, 75S/546R/548S/610R/648A, 168E/207R/ 263T/454L/568P/570E/604P, 168E/263T/266K/546R/604P, 168E/454L/604P, 207R/604P/61 OR, 209V, 212S, 221I, 223Q, 228I, 228V, 266K/454L/568P, 319Q, 373F, 412Y/ 546L/554M, 431T, 454I, 454L/546R/568P/570E/580C, 454L/546R/570E, 454L/570E/580C/610R, 454L/580C, 454L/659T, and 506N, wherein the amino acid positions of the polypeptide sequence are numbered with reference to SEQ ID NO: 1180 or 2150. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the recombinant protease comprises at least one substitution or substitution set selected from R75S/S168E/Q207R/A454L/L568P/ L586V/A610R/R648A/E659T, R75S/S168E/A266K/ A454L/V546R/K570E/H580C, R75S/Q207R/A454L/ K570E/E659T, R75S/Q207R/V546R/H580C/R648A, R75S/S263T/A454L/D548S/L568P/H604P/R648A, R75S/ A266K/A454L, R75S/A454L, R75S/A454L/V546R/ D548S/L568P/H604P, R75S/V546R/D548S/A610R/ R648A, S168E/Q207R/S263T/A454L/L568P/K570E/ H604P, S168E/S263T/A266K/V546R/H604P, S168E/ A454L/H604P, Q207R/H604P/A610R, I209V, D212S, L221I, N223Q, T228I, T228V, A266K/A454L/L568P, N319Q, L373F, F412Y/V546L/L554M, P431T, A454I, A454L/V546R/L568P/K570E/H580C, A454L/V546R/ K570E, A454L/K570E/H580C/A610R, A454L/H580C, A454L/E659T, and G506N, wherein the amino acid positions of the polypeptide sequence are numbered with reference to SEQ ID NO: 1180 or 2150.

In some additional embodiments, the recombinant protease comprises a polypeptide sequence having at least 85%, 80%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the recombinant protease comprises at least one substitution or substitution set at one or more positions selected from 75/189/373/582, 75/200/212/431/482, 75/212/ 373/431/482, 75/212/431/482/568/615/664, 75/368/582, 75/373/431/526/582, 75/431/482/570/604/664, 75/632, 189/ 212/431/568/570, 200/205/373/431, 200/431/482/615/664, 200/482/664, 212/228/431, 212/228/568/570/582/664, 212/ 373/446/482/582, 368/373/431, 373/431/570/604/664, 373/ 568/632, 431, 431/604/664, 482/582, 582, and 615/652/664, wherein the amino acid positions of the polypeptide sequence are numbered with reference to SEQ ID NO: 1250 or 2220. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the recombinant protease comprises at least one substitution or substitution set selected from 75S/ 189A/373F/582G, 75S/200W/212S/431T/482S, 75S/212S/ 373F/431T/482S, 75S/212S/431T/482S/568P/615M/664G, 75S/368M/582G, 75S/373F/431T/526E/582G, 75S/431T/ 482S/570K/604P/664G, 75S/632Q, 189A/212S/431T/568P/ 570K, 200W/205S/373F/431T, 200W/431T/482S/615M/ 664G, 200W/482S/664W, 212S/228V/431T, 212S/228V/ 568P/570K/582G/664W, 212S/373F/446F/482S/582G, 368M/373F/431T, 373F/431T/570K/604P/664W, 373F/ 568P/632Q, 431T, 431T/604P/664G, 482S/582G, 582G, and 615M/652V/664G, wherein the amino acid positions of the polypeptide sequence are numbered with reference to SEQ ID NO: 1250 or 2220. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the recombinant protease comprises at least one substitution or substitution set selected from R75S/K189A/L373F/R582G, R75S/ K200W/D212S/P431T/R482S, R75S/D212S/L373F/ P431T/R482S, R75S/D212S/P431T/R482S/L568P/K615M/ R664G, R75S/K368M/R582G, R75S/L373F/P431T/ R526E/R582G, R75S/P431T/R482S/E570K/H604P/ R664G, R75S/K632Q, K189A/D212S/P431T/L568P/ E570K, K200W/R205S/L373F/P431T, K200W/P431T/ R482S/K615M/R664G, K200W/R482S/R664W, D212S/ T228V/P431T, D212S/T228V/L568P/E570K/R582G/ R664W, D212S/L373F/R446F/R482S/R582G, K368M/ F373F/P431T, F373F/P431T/E570K/H604P/R664W, F373F/F568P/K632Q, P431T, P431T/H604P/R664G, R482S/R582G, R582G, and K615M/K652V/R664G, wherein the amino acid positions of the polypeptide sequence are numbered with reference to SEQ ID NO: 1250 or 2220.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308 or 2278, or a functional fragment thereof, and wherein the recombinant protease comprises at least one substitution or substitution set at one or more positions selected from 408/439, 439/514, 470, 470/667, 514, 514/ 537, and 537, wherein the amino acid positions of the polypeptide sequence are numbered with reference to SEQ ID NO: 1308 or 2278. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308 or 2278, or a functional fragment thereof, and wherein the recombinant protease comprises at least one substitution or substitution set selected from 408A/439S, 439S/514R, 470G, 470G/ 667D, 470P, 514R, 514R/537E, and 537E, wherein the amino acid positions of the polypeptide sequence are numbered with reference to SEQ ID NO: 1308 or 2278. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308, or a functional fragment thereof, and wherein the recombinant protease comprises at least one substitution or substitution set selected from V408A/M439S, M439S/H514R, Q470G, Q470G/G667D, Q470P, H514R, H514R/P537E, and P537E, wherein the amino acid positions of the polypeptide sequence are numbered with reference to SEQ ID NO: 1308 or 2278.

In some additional embodiments, the recombinant protease comprises at least one mutation in at least one position as provided in Tables 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the positions are numbered with reference to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease comprises a polypeptide sequence having at least about 80%, about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the even-numbered sequences of SEQ ID NOS: 4-1362 and 1366-2332. In some further embodiments, the recombinant protease comprises a polypeptide sequence having at least 85%, 86%, 87%, 88%, 89%, 90%, 91%, 92%, 93%, 94%, 95%, 96%, 97%, 98%, 99%, or more sequence identity to at least one sequence set forth in the even-numbered sequences of SEQ ID NOS: 4-1362 and 1366- 2332. In some additional embodiments, the recombinant protease comprises at least one sequence set forth in the even-numbered sequences of SEQ ID NOS: 4-1362 and 1366-2332. In some embodiments, the recombinant protease comprises at least one sequence set forth in the even numbered sequences of SEQ ID NOS: 396-1362, wherein the sequence is absent the histidine tag and the four amino acid linker preceding the histidine tag. In some embodiments, the recombinant protease comprises at least one sequence set forth in the even numbered sequences of SEQ ID NOS: 1366-2332.

In some additional embodiments, the recombinant protease retains more enzymatic activity after exposure to high and/or low temperatures, as compared to a reference sequence. In some embodiments, the reference sequence is wild-type protease, while in some other embodiments, the reference sequence is another recombinant protease. In some additional embodiments, the recombinant protease is more thermostable than the protease of SEQ ID NO: 2. In some further embodiments, the recombinant protease is more thermostable than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease is stable at 40 to 50° C. In some embodiments, the recombinant protease is stable at 25° C., 37° C. 42° C., and/or 48° C. In some additional embodiments, the recombinant protease is more stable than a reference sequence at 40 to 50° C. In some embodiments, the recombinant protease is more stable than a reference sequence at 25° C., 37° C., 42° C., and/or 48° C. In some additional embodiments, the recombinant protease is more thermostable than the protease of SEQ ID NO: 2. In some further embodiments, the recombinant protease is more thermostable than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease is stable in low pH environments, while in other embodiments, the recombinant protease is stable in high pH environments, and in still further embodiments, the recombinant protease is stable in neutral pH environments. In some embodiments, the recombinant protease is stable in low and high pH environments, and in some additional embodiments, the protease is stable in low, neutral and high pH environments. In some embodiments, the recombinant protease retains enzymatic activity after exposure to a low, high, and/or neutral pH environment. In some additional embodiments, the recombinant protease is more stable at high, neutral, and/or low pH environment(s), as compared to a reference sequence. In some embodiments, the reference sequence is wild-type protease, while in other embodiments, the reference sequence is another engineered protease. In some additional embodiments, the recombinant protease is more stable in low, neutral and high pH environments than the protease of SEQ ID NO: 2. In some further embodiments, the recombinant protease is more stable in low, neutral and high pH environments than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pHs greater than 7, than the protease of SEQ ID NO: 2. In some additional embodiments, the recombinant protease is more stable at pHs greater than 7, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 7.8, than the protease of SEQ ID NO: 2. In some additional embodiments, the recombinant protease is more stable at pH 7.8, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 7.5, than the protease of SEQ ID NO: 2. In some additional embodiments, the recombinant protease is more stable at pH 7.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 7, than the protease of SEQ ID NO: 2. In some additional embodiments, the recombinant protease is more stable at pH 7, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pHs less than 7 (i.e., under acidic pH conditions or levels), than the protease of SEQ ID NO: 2. In some additional embodiments, the recombinant protease is more stable at pHs less than pH 7 (i.e., under acidic pH conditions or levels), than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 6.5, than the protease of SEQ ID NO: 2. In some additional embodiments, the recombinant protease is more stable at pH 6.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 6, than the protease of SEQ ID NO: 2. In some additional embodiments, the recombinant protease is more stable at pH 6, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pHs less than 5, than the protease of SEQ ID NO: 2. In some additional embodiments, the recombinant protease is more stable at pH 5, than the protease of SEQ ID NO: 2. In some additional embodiments, the recombinant protease is more stable at pH 5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 4, than the protease of SEQ ID NO: 2. In some further embodiments, the recombinant protease is more stable at pH 5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 3.8, than the protease of SEQ ID NO: 2. In some additional embodiments, the recombinant protease is more stable at pH 3.8, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 3.5, than the protease of SEQ ID NO: 2. In some further embodiments, the recombinant protease is more stable at pH 3.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 3, than the protease of SEQ ID NO: 2. In some additional embodiments, the recombinant protease is more stable at pH 3.26, than the protease of SEQ ID NO: 2. In some additional embodiments, the recombinant protease is more stable at pH 3.26, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 3, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 2.75, than the protease of SEQ ID NO: 2. In some additional embodiments, the recombinant protease is more stable at pH 2.75, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 2.5, than the protease of SEQ ID NO: 2. In some further embodiments, the recombinant protease is more stable at pH 2.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 2, than the protease of SEQ ID NO: 2. In some further embodiments, the recombinant protease is more stable at pH 2, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease is more active at pH 6 than pH 7. In some embodiments, the recombinant protease is more active at pH 6, than pH 7, than the protease of SEQ ID NO: 2. In some additional embodiments, the recombinant protease is more active at pH 6 than pH 7, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease is more resistant to proteolysis than the protease of SEQ ID NO: 2. In some embodiments, the recombinant protease is more resistant to proteolysis than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease is resistant to proteolysis by pepsin. In some additional embodiments, the recombinant protease is more resistant to proteolysis by pepsin than the protease of SEQ ID NO: 2. In some embodiments, the recombinant protease is more resistant to proteolysis by pepsin than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is resistant to proteolysis by trypsin. In some additional embodiments, the recombinant protease is more resistant to proteolysis by trypsin than the protease of SEQ ID NO: 2. In some embodiments, the recombinant protease is more resistant to proteolysis by trypsin than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease is resistant to proteolysis by chymotrypsin. In some additional embodiments, the recombinant protease is more resistant to proteolysis by chymotrypsin than the protease of SEQ ID NO: 2. In some embodiments, the recombinant protease is more resistant to proteolysis by chymotrypsin than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is resistant to proteolysis by pepsin, trypsin, and/or chymotrypsin. In some additional embodiments, the recombinant protease is more resistant to proteolysis by pepsin, trypsin, and/or chymotrypsin, than the protease of SEQ ID NO: 2. In some embodiments, the recombinant protease is more resistant to proteolysis by pepsin, trypsin, and/or chymotrypsin, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease of the present invention is resistant to autolysis (i.e., proteolysis of the recombinant protease by the recombinant protease itself). In some embodiments, the recombinant protease is more resistant to autolysis than the protease of SEQ ID NO: 2. In some embodiments, the recombinant protease is more resistant to autolysis than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some additional embodiments, the recombinant protease is active in the presence of at least one bile salt. In some additional embodiments, the recombinant protease is more active in the presence of at least one bile salt than the protease of SEQ ID NO: 2. In some additional embodiments, the recombinant protease is more active in the presence of at least one bile salt than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease retains enzymatic activity after exposure to a bile salt. In some additional embodiments, the recombinant protease retains more enzymatic activity after exposure to a bile salt, as compared to a reference sequence. In some embodiments, the reference sequence is the protease of SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the bile salt is taurocholate.

In yet some additional embodiments, the recombinant protease exhibits more than one improved property, as compared to wild-type protease or another recombinant protease. In some embodiments, the recombinant protease exhibits more than one improved property as compared to SEQ ID NO:2, while in some additional embodiments, the recombinant protease exhibits more than one improved property as compared to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the improved properties are selected from acid stability, alkaline stability, stability at acidic pH, stability at alkaline pH, stability at neutral pH, thermostability, proteolysis resistance, autolysis resistance, increased activity at acidic pH, and increased activity in the presence of at least one bile salt. In some embodiments, the improved properties are selected from acid stability, stability at acidic pH, thermostability, proteolysis resistance, autolysis resistance, increased activity at acidic pH, and increased activity in the presence of at least one bile salt. In yet some additional embodiments, the recombinant protease is more stable and/or active at acidic pHs, more thermostable, more resistant to proteolysis, and/or more active in the presence of at least one bile salt than the protease of SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. It is contemplated that any combination of improved properties will find use in the present invention. It is not intended that the present invention be limited to any specific combination of improved properties. Furthermore, in some embodiments, there are two improved properties, while in some other embodiments, there are three improved properties, in some additional embodiments, there are four improved properties, and in some additional embodiments, there are five or more improved properties. It is also contemplated that the recombinant protease of the present invention furthers comprise additional improvements. In some embodiments, these additional improvements provide advantages over wild-type protease, while in some other embodiments, the additional improvements will provide advantages over other recombinant proteases.

In some embodiments, the recombinant protease exhibits at least one improved property selected from improved stability and/or activity at acidic pHs, improved thermostability, improved resistance to proteolysis, improved stability to and/or improved activity in the presence of at least one bile salt, as compared to the protease of SEQ ID NO: 2. In some embodiments, the recombinant protease exhibits at least one improved property selected from improved stability and/or activity at acidic pHs, improved thermostability, improved resistance to proteolysis, improved stability to and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least two improved properties selected from improved stability and/or activity at acidic pHs, improved thermostability, improved stability to autolysis, improved resistance to proteolysis, and/or improved activity in the presence of at least one bile salt, as compared to the protease of SEQ ID NO: 2. In some embodiments, the recombinant protease exhibits at least two improved properties selected from improved stability and/or activity at acidic pHs, improved thermostability, improved resistance to proteolysis, improved stability to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least three improved properties selected from improved stability and/or activity at acidic pHs, improved thermostability, improved resistance to proteolysis, improved stability to autolysis, and/or improved activity in the presence of at least one bile salt, as compared to the protease of SEQ ID NO: 2. In some embodiments, the recombinant protease exhibits at least three improved properties selected from improved stability and/or activity at acidic pHs, improved thermostability, improved resistance to proteolysis, improved stability to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits the improved properties of improved stability and/or activity at acidic pHs, improved thermostability, improved stability to autolysis, improved resistance to proteolysis, and improved activity in the presence of at least one bile salt, as compared to the protease of SEQ ID NO: 2. In some embodiments, the recombinant protease exhibits the improved properties of improved stability and/or activity at acidic pHs, improved thermostability, improved resistance to proteolysis, improved stability to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from improved stability and/or activity at acidic pHs, improved thermostability, improved resistance to proteolysis, improved stability to autolysis, and/or improved activity in the presence of at least one bile salt, as well as at least one additional improved property, as compared to the protease of SEQ ID NO: 2. In some embodiments, the recombinant protease exhibits at least one improved property selected from improved stability and/or activity at acidic pHs, improved thermostability, improved resistance to proteolysis, improved stability to autolysis, and/or improved activity in the presence of at least one bile salt, as well as at least one additional improved property, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermotolerance; viii) increased stability to autolysis, or a combination of any of i), ii), iii), iv), v), vi), vii), and viii), as compared to a reference sequence. In some embodiments, the reference sequence is SEQ ID NO: 2, while in some alternative embodiments, the reference sequence is selected from SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermo tolerance; viii) increased tolerance to autolysis; or a combination of any of i), ii), iii), iv), v), vi), vii), and viii), as compared to at least one reference sequence. In some embodiments, the reference sequence is SEQ ID NO: 2, while in some alternative embodiments, the reference sequence is selected from SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermo tolerance; viii) increased tolerance to autolysis, or a combination of any of i), ii), iii), iv), v), vi), vii), and viii), as compared to at least two or more reference sequences. In some embodiments, the reference sequence is selected from SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is purified.

In still some further embodiments, the protease is stable in food and/or beverages. In some additional embodiments, the protease is stable in nutritional and other supplements. In some embodiments, the supplements are liquid, while in other embodiments, they are emulsions, suspensions, or solids. It is not intended that the present invention be limited to any particular food, beverage, and/or supplement format or form.

The present invention also provides recombinant polynucleotide sequences encoding at least one recombinant protease provided herein. In some embodiments, the recombinant polynucleotide sequence is codon-optimized. In some further embodiments, the recombinant polynucleotide comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 3-1361 and 1365-2331. In some further embodiments, the polynucleotide comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 3-1361 and 1365-2331. In some additional embodiments, the present invention provides at least one sequence set forth in the odd-numbered sequences of SEQ ID NOS: 3-1361 and 1365-2331. In some additional embodiments, the recombinant polynucleotide sequence comprises a sequence selected from the odd-numbered sequences of SEQ ID NOS: 3-1361 and 1365-2331. In some embodiments, the recombinant polynucleotide sequence comprises a sequence selected from the odd-numbered sequences of SEQ ID NOS: 3-1361 and 1365-2331, wherein said sequence encodes a recombinant polypeptide provided herein. In some embodiments, the recombinant polynucleotide sequence comprises a sequence selected from the odd-numbered sequences of SEQ ID NOS: 3-1361 and 1365-2331, wherein said sequence encodes a recombinant polypeptide provided in an even-numbered sequence provided in SEQ ID NO: 4-1362 and 1366-2332. In some further embodiments, the recombinant polynucleotide encoding a recombinant protease provided herein comprises a sequence having at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the odd-numbered sequences of SEQ ID NOS: 3-1361 and 1365-2331. In some further embodiments, the recombinant polynucleotide encoding a recombinant protease provided herein comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 3-1361 and 1365-2331. In some further embodiments, the recombinant polynucleotide encoding a recombinant protease provided herein comprises a sequence having at least 85%, 86%, 87%, 88%, 89%, 90%, 91%, 92%, 93%, 94%, 95%, 96%, 97%, 98%, 99%, or more sequence identity to at least one sequence set forth in the odd-numbered sequences of SEQ ID NOS: 3-1361 and 1365-2331, wherein the recombinant protease comprises a polypeptide sequence comprising an even-numbered sequence provided in SEQ ID NOS: 4-1362 and 1366-2332.

The present invention also provides expression vectors comprising at least one recombinant polynucleotide sequence provided herein. The present invention also provides expression vectors comprising at least one recombinant polynucleotide sequence encoding at least one recombinant protease provided herein. In some additional embodiments, the recombinant polynucleotide sequence is operably linked to a control sequence. In some embodiments, the control sequence is a promoter. In some further embodiments, the promoter is a heterologous promoter.

The present invention also provides host cells comprising at least one expression vector provided herein. The present invention also provides host cells comprising at least one expression vector comprising at least one recombinant polynucleotide sequence encoding at least one recombinant protease provided herein. The present invention also provides host cells comprising an expression vector comprising at least one recombinant polynucleotide sequence encoding at least one recombinant protease provided herein. The present invention also provides host cells comprising an expression vector comprising at least one recombinant polynucleotide sequence encoding a recombinant protease provided herein. In some embodiments, the host cell is eukaryotic, while in some alternative embodiments, the host cell is prokaryotic. In some embodiments, the host cell is *Escherichia coli*. In some alternative embodiments, the host cell is *Saccharomyces cerevisiae*.

The present invention also provides methods of producing at least one recombinant protease, comprising culturing at least one host cell provided herein, under conditions that the recombinant protease encoded by the recombinant polynucleotide is produced. In some embodiments, the methods further comprise the step of recovering the protease. In yet some additional embodiments, the methods further comprise the step of purifying the protease.

The present invention also provides compositions comprising at least one recombinant protease provided herein. In some embodiments, the composition comprising at least one recombinant protease comprises a pharmaceutical composition. In some additional embodiments, the pharmaceutical composition is suitable for the treatment of pancreatic insufficiency. In some additional embodiments, the pharmaceutical composition further comprising a pharmaceutically acceptable carrier and/or excipient. In some embodiments, the pharmaceutical composition is suitable for parenteral injection or infusion to a human. In some embodiments, the pharmaceutical composition is suitable for oral administration to a human. In some additional embodiments, the pharmaceutical composition further comprises at least one lipase. The present invention also provides compositions comprising at least one recombinant protease provided herein, wherein the compositions are suitable for other uses. In some embodiments, the present invention provides methods for hydrolyzing protein in vivo or in vitro, comprising providing protein and at least one engineered protease of the present invention, and exposing the protein to at least one engineered protease under conditions that the protein is hydrolyzed.

The present invention also provides methods for treating and/or preventing the symptoms of pancreatic insufficiency in a subject, comprising providing a subject having pancreatic insufficiency, and providing the pharmaceutical composition provided herein to the subject. In some embodiments, the symptoms of pancreatic insufficiency are ameliorated in a subject, upon the administration of the composition comprising at least one recombinant protease to the subject. In some additional embodiments, the pharmaceutical composition further comprises at least one lipase. In some further embodiments, the pharmaceutical composition further comprises at least one amylase. In yet some additional embodiments, the pharmaceutical composition further comprises at least one lipase and at least one amylase. In some further embodiments, the subject is able to eat a diet that is less restricted in its protein content than diets required by subjects exhibiting the symptoms of pancreatic insufficiency. In some additional embodiments, the subject is a human patient. In some embodiments, the human patient is an infant, while in some other embodiments, the human patient is a child. In yet some further embodiments, the human patient is an adult, while in some alternative embodiments, the human patient is a young adult. In some embodiments, the subject is a non-human mammal. The present invention further provides medicaments comprising at least one recombinant protease provided herein. The present invention also provides for use of the compositions comprising at least one recombinant protease provided herein.

The present invention also provides methods for protein hydrolysis, comprising providing protein and at least one engineered protease provided herein; and exposing the protein to at least one such engineered protease under conditions such that the protein is hydrolyzed by the engineered protease. In some additional embodiments, the present invention also provides methods for protein hydrolysis, comprising providing protein and the composition comprising at least one engineered protease provided herein; and exposing the protein to the composition under conditions such that the protein is hydrolyzed by the engineered protease of the composition.

DESCRIPTION OF THE INVENTION

Figure 1:
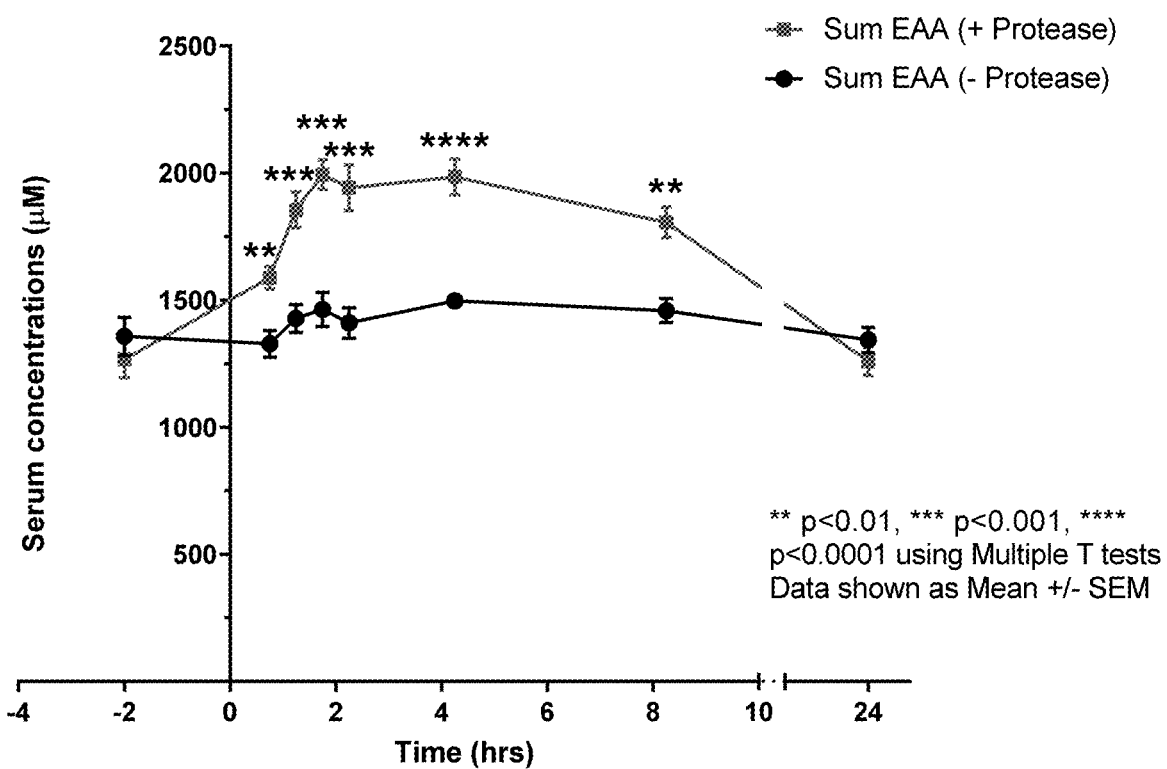
FIG. 1 provides a graph showing the results described in Example 6. As shown in this Figure, the sum total of essential amino acids (EAA; methionine, leucine, valine, isoleucine, phenylalanine, histidine, lysine, threonine, and tryptophan) was significantly increased post-prandially after 14 days of dosing with SEQ ID NO: 756 [Sum EAA (+Protease)] compared to pre-dose [Sum EAA (−Protease)]. HPD was provided to the miniature swine at time 0. Pre-prandial baseline values were not different between groups, and serum EAA levels returned to baseline after 24 hours. Statistical significance was determined between pre-dose (−Protease) and post-dose (+Protease) time points using a Multiple T-test in GraphPad Prism 7 (GraphPad).
Figure 2:
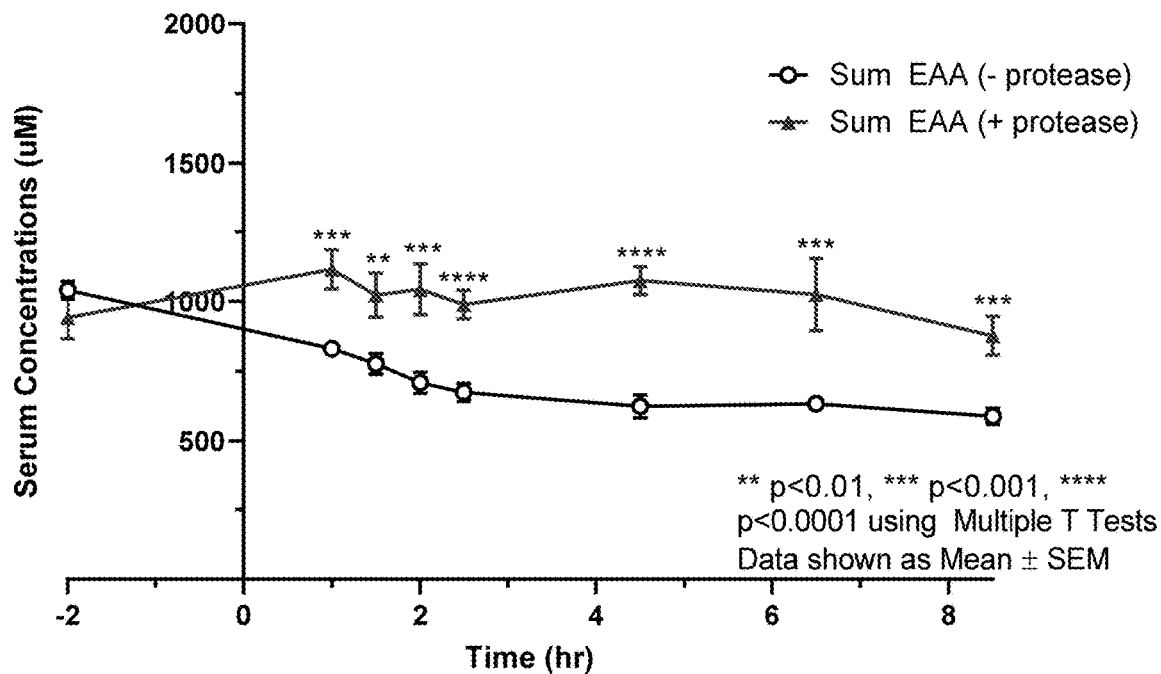
FIG. 2. The sum total of serum essential amino acids (EAA; methionine, leucine, valine, isoleucine, phenylalanine, histidine, lysine, threonine, and tryptophan) over 8.5 hours post-dose (A) and the area under the curve (AUC; B) was significantly increased post-prandially after 14 days of dosing with SEQ ID NO: 2332 [Sum EAA (+Protease)] compared to pre-dose [Sum EAA (−Protease)]. HPD was provided to miniswine at time 0. Pre-prandial baseline values were not different between groups. Statistical significance was determined between pre-dose (−Protease) and post-dose (+Protease) time points using a Multiple T-test in GraphPad Prism 7 (GraphPad Software, San Diego, CA).
Figure 2:
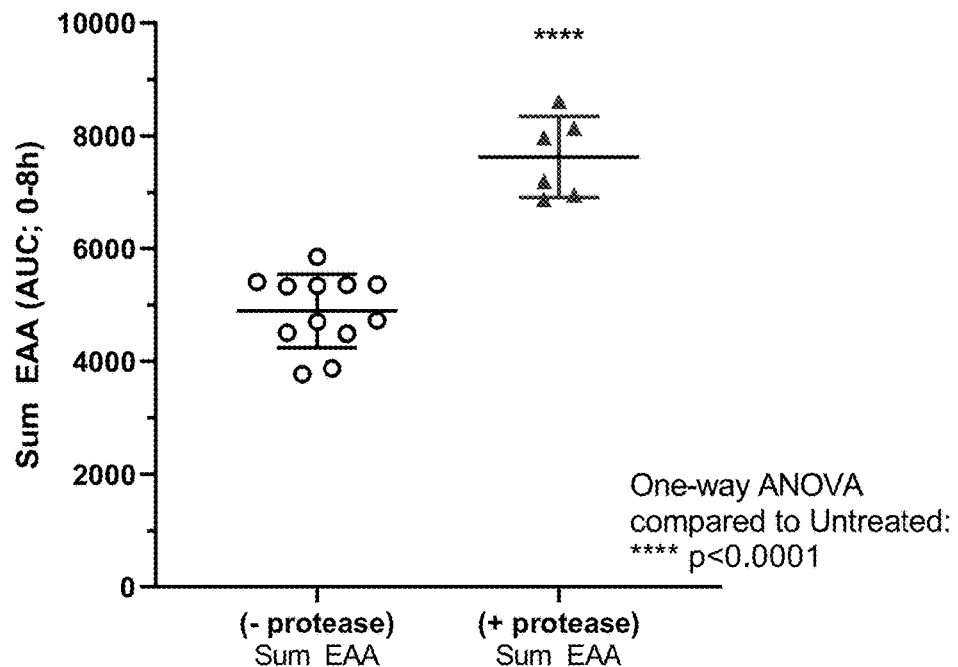

The present invention provides engineered protease polypeptides and compositions thereof. The engineered protease polypeptides have been optimized to provide improved activity, improved thermostability, protease stability, autolytic stability, and stability under a range of pH conditions, including acidic (pH<7) conditions. The invention also relates to the use of the compositions comprising the engineered protease polypeptides for therapeutic purposes. In some embodiments, the protease variants of the present invention find use in PERT treatment of PEI conditions. In some additional embodiments, the protease is administered in formats that do not require an enteric coating and/or proton-pump inhibitors (PPIs). The present invention also provides polynucleotides encoding the engineered protease polypeptides, as well as methods for making the engineered polynucleotides and protease polypeptides.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, biochemistry, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

As used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

As used herein, the term "protease" (and "proteinase" and "peptidase") refers to the numerous enzymes that hydrolyze proteins. There are numerous proteases involved in the breakdown of proteins into smaller polypeptide unties or single amino acids. Proteases are important for numerous biological functions, including digestion of ingested proteins, protein catabolism, and cell signaling.

As used herein, the term "proteolysis" refers to the breakdown (e.g., through hydrolysis) of proteins and/or polypeptides into smaller peptides and/or amino acids.

As used herein, the term "autolysis" refers to the self-destruction or self-digestion of cells and/or enzymes. Exemplary situations involving autolysis include the breakdown of proteases through their own action on their structures (i.e., the proteases degrade or destroy themselves).

As used herein, the term "lipase" refers to any enzyme commonly referred to as "lipase," that catalyzes the hydrolysis of fats by hydrolyzing the ester bonds of triglycerides. Pancreatic lipases are important in the breakdown of fats to fatty acids, glycerol, and other alcohols. Lipases are essential in the digestion, transport, and processing of dietary lipids in most organisms.

As used herein, the term "lipid" refers to a class of water-insoluble macromolecules that include fatty acids and their esters, sterols, prenols, certain poorly soluble vitamins, and other related compounds. "Fats" are a subset of lipids composed of fatty acid esters (e.g., triglycerides, which are made from glycerol and three fatty acids). It is not intended that the present invention be limited to any specific lipid and/or fat. Taking the context into consideration, the terms "fat" and "lipid" are used interchangeably herein.

As used herein, the terms "protein," "polypeptide," and "peptide" are used interchangeably herein to denote a polymer of at least two amino acids covalently linked by an amide bond, regardless of length or post-translational modification (e.g., glycosylation or phosphorylation).

As used herein, the term "amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

Recombinant polypeptides can be produced using any suitable methods known the art. Genes encoding the wild-type polypeptide of interest can be cloned in vectors, such as plasmids, and expressed in desired hosts, such as *E. coli, S. cerevisiae*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant protease polypeptides" (also referred to herein as "engineered protease polypeptides," "variant protease enzymes," and "protease variants") find use.

As used herein, the term "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

As used herein, the term "coding sequence" refers to that part of a nucleic acid (e.g., a gene) that encodes an amino acid sequence of a protein.

As used herein, "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BEAST and BLAST 2.0 algorithms, which are described by Altschul et al. (See, Altschul et al., J. Mol. Biol., 215: 403-410 [1990]; and Altschul et al., Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

As used herein, the term "reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. "Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered protease, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, the term "mutation" refers to any change in a polypeptide or polynucleotide sequence. It is intended to encompass any number (i.e., one or more) of substitutions, insertions, deletions, and/or rearrangements present in a sequence (i.e., as compared to the starting or reference sequence). Thus, mutations in sequences result in the production of variant polypeptides (e.g., variant or recombinant proteases), as provided herein.

As used herein, "amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X92 as compared to SEQ ID NO: 2" refers to a difference of the amino acid residue at the polypeptide position corresponding to position 92 of SEQ ID NO: 2. Thus, if the reference polypeptide of SEQ ID NO: 2 has a threonine at position 92, then a "residue difference at position X92 as compared to SEQ ID NO:2" means there is an amino acid residue other than threonine at the position of the polypeptide corresponding to position 92 of SEQ ID NO: 2 (e.g., T92A). In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X446A/X446G/X446M or X446A/G/M or P446A/G/M). In some embodiments, the enzyme variants comprise more than one substitution. These substitutions are separated by a slash for ease in reading (e.g., V408A/M439S). The present application includes engineered polypeptide sequences comprising one or more amino acid differences that include either/or both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., pro line for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, the term "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, an asterisk (*) used in the context of a polynucleotide sequence indicates the presence of a stop codon within the polynucleotide sequence. In some embodiments, the variant proteases are truncated, as compared to the starting or reference sequence, due to the presence of stop codons.

As used herein, the term "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" and a "biologically active fragment" are used interchangeably herein refers to a polypeptide that has an amino-terminal and/or carboxy-terminal deletion(s) and/or internal deletions (e.g., the sequence is truncated), but where the remaining amino acid sequence is identical to the corresponding positions in the sequence to which it is being compared (e.g., a full-length engineered protease of the present invention) and that retains substantially all of the activity of the full-length polypeptide.

As used herein, "isolated polypeptide" refers to a polypeptide that is substantially separated from other contaminants that naturally accompany it (e.g., protein, lipids, and polynucleotides). The term embraces polypeptides that have been removed or purified from their naturally-occurring environment or expression system (e.g., host cell or in vitro synthesis). The recombinant protease polypeptides may be present within a cell, present in the cellular medium, or prepared in various forms, such as lysates or isolated preparations. As such, in some embodiments, the recombinant protease polypeptides can be an isolated polypeptide.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure protease composition comprises about 60% or more, about 70% or more, about 80% or more, about 90% or more, about 95% or more, and about 98% or more of all macromolecular species by mole or % weight present in the composition. In some embodiments, the object species is purified from a starting preparation to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant protease polypeptides are substantially pure polypeptide compositions. In some embodiments, substantially pure recombinant protease polypeptide preparations added to formulations suitable for use in the present invention (e.g., polysaccharides, surfactants, etc.).

As used herein, an "improved enzyme property" and "improved property" refers to a property of an engineered protease polypeptide which comprises an improvement in any enzyme property as compared to a reference protease polypeptide and/or as a wild-type protease polypeptide or another engineered protease polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic or basic pH, increased tolerance to proteolytic activity (i.e., reduced sensitivity to proteolysis), reduced aggregation, increased solubility, reduced immunogenicity, improved post-translational modification (e.g., glycosylation), and altered temperature profile.

As used herein, "increased enzymatic activity" or "enhanced catalytic activity" refers to an improved property of the engineered protease polypeptides, that can be represented by an increase in specific activity (e.g., product produced/time/weight protein) or an increase in percent conversion of the substrate to the product (e.g., percent conversion of starting amount of substrate to product in a specified time period using a specified amount of protease) as compared to the reference protease enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring protease or another engineered protease from which the protease polypeptides were derived.

Protease activity can be measured by any suitable method known in the art (e.g., standard assays, such as monitoring changes in spectrophotometric properties of reactants or products). In some embodiments, the amount of products produced can be measured using fluorescence-based assays such as the ENZCHEK™ Protease Assay kit (ThermoFisher), while in some other embodiments, the products can be measured using alternative methods known in the art. Comparisons of enzyme activities are made using a defined preparation of enzyme, a defined assay under a set condition, and one or more defined substrates, as further described in detail herein.

As used herein, the terms "protease stable" and "stability to proteolysis" refer to the ability of a protein (e.g., a recombinant protease of the present invention) to function and withstand proteolysis mediated by any proteolytic enzyme or other proteolytic compound or factor and retain its function following treatment with the protease. It is not intended that the term be limited to the use of any particular protease to assess the stability of a protein. Indeed, the engineered proteases of the present invention are stable and retain enzymatic activity in the presence of various proteases. In some embodiments, the engineered proteases are stable in the presence of trypsin, chymotrypsin, and/or pepsin. However, it is not intended that the present invention be limited to any specific protease or any particular method of assessing proteolytic stability.

As used herein, the term "pH stability" refers to the ability of a protein (e.g., a recombinant protease of the present invention) to function after incubation at a particular pH. In some embodiments, the present invention provides recombinant proteases that are stable at a range of pHs, including, but not limited to the range of pH 2 to pH 7. In some embodiments, the recombinant proteases are stable at different pH ranges, as indicated in the Examples provided herein. It is not intended that the present invention be limited to any pH stability level nor pH range.

As used herein, the term "improved tolerance to acidic pH" means that a recombinant protease according to the invention will have increased stability (higher retained activity at about pH 7, 6, 5, 4 3, 2, or even lower, after exposure to acidic pH for a specified period of time [e.g., 1 hour, up to 24 hours, etc.]) as compared to a reference protease or another enzyme.

As used herein, the term "physiological pH" refers to the pH range generally found in a subject's (e.g., human) blood (e.g., pH 7.2-7.4).

As used herein, the term "basic pH" (e.g., used with reference to improved stability to basic pH conditions or increased tolerance to basic pH) means a pH range of about 7 to 11, or in some embodiments, greater than pH 11.

As used herein, the term "acidic pH" (e.g., used with reference to improved stability to acidic pH conditions or increased tolerance to acidic pH) means a pH range that encompasses any pH values less than 7. In some embodiments, the acid pH is less than 7, while in some other embodiments, the pH is less than about 6, 5, 4, 3, 2, or lower. In some alternative embodiments, the recombinant proteases of the present invention are stable at pH levels of 2 to 4. However, it is not intended that the present invention be limited to any specific pH value or range of values.

As used herein, the phrase "gastric challenge" refers to the exposure of the recombinant proteases of the present invention to a low pH environment and the presence of at least one enzyme (e.g., pepsin), such that the recombinant lipase is exposed to the conditions that may be encountered in the stomach (e.g., the human stomach).

As used herein, the phrase "intestinal challenge" refers to the exposure of the recombinant proteases of the present invention to a neutral pH environment and the presence of at least one protease (e.g., an intestinal protease, such as trypsin and/or chymotrypsin), and/or at least one bile salt (e.g., sodium taurocholate), such that the recombinant protease is exposed to the conditions that may be encountered in the intestinal tract (e.g., human intestines).

As used herein, the phrase "multiple challenges in sequence" refers to the exposure of the recombinant proteases of the present invention to a series of challenge conditions. For example, in some embodiments, a one hour heat challenge was followed by a one hour gastric challenge, and then followed by a one hour intestinal challenge. It is not intended that the present invention be limited to any specific challenges and/or challenge conditions or a specific sequence of challenges.

As used herein, the terms "thermal stability" and "thermostability" refer to the ability of a protein (e.g., a recombinant protease of the present invention) to function at a particular temperature. In some embodiments, the term refers to the ability of a protein to function following incubation at a particular temperature. In some embodiments, the recombinant proteases of the present invention are "thermotolerant" (i.e., the enzymes maintain their catalytic activity at elevated temperatures). In some embodiments, the recombinant proteases resist inactivation at elevated temperatures and in some embodiments, maintain catalytic activity at elevated temperatures for prolonged exposure times. These terms are used interchangeably herein. It is not intended that the present invention be limited to any specific temperature and/or exposure time. Such stability can be measured by any method known in the art (e.g., the methods described herein). It is not intended that the present invention be limited to any specific temperature stability level nor temperature range. In some embodiments, thermal stability is measured following incubation of a protein (e.g., a recombinant protease of the present invention) at a particular temperature.

As used herein, the term "thermal stability" refers to the ability of a protein (e.g., a recombinant protease of the present invention) to function at a particular temperature. Thermal stability can be measured by any method known in the art (e.g., the methods described herein). It is not intended that the present invention be limited to any specific temperature stability level nor temperature range. In some embodiments, thermal stability is measured following incubation of a protein (e.g., a recombinant protease of the present invention) at a particular temperature. Thus, in some embodiments, the term refers to the ability of a protein (e.g., a recombinant protease of the present invention) to function at a particular temperature after being incubated at a particular temperature.

As used herein, the term "chemical stability" refers to the ability of a protein (e.g., a recombinant protease of the present invention) to function in the presence of a chemical that adversely affects the function of another protein. It is not intended that the present invention be limited to any specific chemical stability level nor range of chemical stabilities.

As used herein, the term "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a protease polypeptide can be expressed as "percent conversion" of the substrate to the product in a specific period of time.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C.

"High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

As used herein, the term "vector" refers to a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, plasmids find use as vectors. In some embodiments, an "expression vector" has a promoter sequence operably linked to the DNA sequence (e.g., transgene) to drive expression in a host cell, and in some embodiments, also comprises a transcription terminator sequence.

As used herein, "codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the protease enzymes may be codon optimized for optimal production from the host organism selected for expression.

As used herein, "control sequence" includes all components that are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

As used herein, "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence that shows transcriptional activity in the host cell of choice including mutant, truncated, and hybrid promoters, and may be obtained from genes encoding extracellular or intracellular polypeptides either homologous or heterologous to the host cell.

As used herein, the phrase "suitable reaction conditions" refers to those conditions in the enzymatic conversion reaction solution (e.g., ranges of enzyme loading, substrate loading, temperature, pH, buffers, co-solvents, etc.) under which a protease polypeptide of the present application is capable of converting a substrate to the desired product compound, Exemplary "suitable reaction conditions" are provided in the present application and illustrated by the Examples.

As used herein, the term "loading," such as in "compound loading" or "enzyme loading" refers to the concentration or amount of a component in a reaction mixture at the start of the reaction.

As used herein, the term "substrate" used in the context of an enzymatic conversion reaction process refers to the compound or molecule acted on by the protease polypeptide.

As used herein, the term "product" in the context of an enzymatic conversion process refers to the compound or molecule resulting from the action of the protease polypeptide on a substrate.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the protease variants). In some embodiments, the host cells are prokaryotic or eukaryotic cells that have been transformed or transfected with vectors constructed using recombinant DNA techniques as known in the art.

As used herein, the term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues comprise polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

As used herein, the term "culturing" refers to the growing of a population of cells under any suitable conditions (e.g., using a liquid, gel or solid medium). In some embodiments, the cells are microbial cells (e.g., bacteria), while in some other embodiments, the cells are mammalian cells, insect cells, or cells obtained from another animal. It is not intended that the present invention be limited to culturing of any particular cells or cell types or any specific method of culturing. Indeed, it is intended that the present invention encompass any suitable cell types cultured under any suitable conditions.

As used herein, the term "therapeutic" refers to a compound that provides beneficial or desirable effects, including medical effects, when it is administered to a subject who shows signs or symptoms of pathology.

As used herein, the term "pharmaceutical composition" refers to a composition suitable for pharmaceutical use in a subject (e.g., human) comprising a pharmaceutically effective amount of an engineered protease polypeptide encompassed by the invention and an acceptable carrier.

As used herein, the term "effective amount" means an amount sufficient to produce the desired result. One of general skill in the art may determine what the effective amount by using routine experimentation.

As used herein, the term "subject" encompasses animals, including but not limited to mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

As used herein, the term "infant" refers to a child in the period of the first month after birth to approximately one (1) year of age. As used herein, the term "newborn" refers to child in the period from birth to the 28$^{th}$ day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered protease of the present invention, intended for any suitable use (e.g., pharmaceutical compositions, dietary and/or nutritional supplements, feed, etc.).

As used herein, the terms "administration" and "administering" a composition mean providing a composition of the present invention to a subject (e.g., to a person suffering from the effects of pancreatic insufficiency).

As used herein, the term "carrier" when used in reference to a pharmaceutical composition means any of the standard pharmaceutical carrier, buffers, and excipients, such as stabilizers, preservatives, and adjuvants.

As used herein, the term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered protease polypeptides of the present invention). Excipients are typically included for formulation and/or administration purposes.

As used herein, the term "therapeutically effective amount" when used in reference to symptoms of disease/condition refers to the amount and/or concentration of a compound (e.g., engineered protease polypeptides) that ameliorates, attenuates, or eliminates one or more symptom of a disease/condition or prevents or delays the onset of symptom(s).

As used herein, the term "therapeutically effective amount" when used in reference to a disease/condition refers to the amount and/or concentration of a composition (e.g., engineered protease polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

As used herein, the terms "treating," "treat," and "treatment" refer to medical care given to a subject (e.g., a human patient), including administration of pharmaceutical compositions, such as those provided herein. It is intended that the terms "treating," "treat" and "treatment" encompass preventative (e.g., prophylactic), as well as palliative treatment or care. In some embodiments, treatment is provided to prevent or ameliorate the symptoms of disease. In some embodiments, the pharmaceutical compositions of the present invention find use in the treatment or prevention of pancreatic enzyme insufficiency disease or conditions.

Engineered Protease Polypeptides

The present invention provides engineered proteases suitable for various uses, including treatment of pancreatic enzyme insufficiency. In some embodiments the engineered protease exhibits at least one improved property compared to wild-type protease (e.g., the polypeptide of SEQ ID NO: 2). In some embodiments, the engineered protease has at least about 75%, at least about 75%, at least about 80%, at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO: 2, 34, 190, 292, 342, 382, 396, 400, 454, 562, 638, 680, 756, 812, 1030, 1136, 1180, 1250 1308, 1366, 1370, 1424, 1532, 1608, 1650, 1726, 1782, 2000, 2106, 2150, 2220, and/or 2278, and an amino acid residue difference as compared to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278, at one or more amino acid positions (such as at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acid positions compared to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278, or a sequence having at least 70%, 75%, 80%, 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the residue difference as compared to SEQ ID NO: 2, 34, 190, 292, 342, 382, 400, 454, 562, 638, 680, 756, 812, 1030, 1136, 1180, 1250, and/or 1308, at one or more positions include at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more conservative amino acid substitutions. In some embodiments, the engineered protease polypeptide comprises a polypeptide listed in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27. In some embodiments, the engineered protease polypeptide comprises a polypeptide listed in Table 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the engineered protease is absent (i.e., lacking) the histidine tag and the preceding amino acid linker at the carboxy terminus. In some embodiments, the engineered protease polypeptide comprises SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the engineered protease polypeptide comprises SEQ ID NO: 34, 190, 292, 342, 382, 1366, 1370, 1424, 1532, 1608, 1650, 1726, 1782, 2000, 2106, 2150, 2220, and/or 2278.

The present invention provide recombinant proteases and/or biologically active recombinant protease fragments comprising amino acid sequences comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO: 2. In some embodiments, the recombinant protease and/or biologically active recombinant protease fragment comprises a polypeptide sequence having at least about 70%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

The present invention provide recombinant proteases and/or biologically active recombinant protease fragments comprising amino acid sequences comprising at least 70%, at least 75%, at least 80%, at least 85%, at least 90%, at least 91%, at least 92%, at least 93%, at least 94%, at least 95%, at least 96%, at least 97%, at least 98%, or at least 99% sequence identity to SEQ ID NO: 2. In some embodiments, the recombinant protease comprises a polypeptide sequence having at least at least 70%, at least 75%, at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises one or more substitutions relative to sequence of SEQ ID NO:2.

In some embodiments, the recombinant protease comprises a polypeptide sequence having at least at least 70%, at least 75%, at least 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises one or more substitutions at positions selected from 9, 17, 29, 30, 32, 34, 35, 36, 37, 43, 47, 50, 63, 75, 77, 81, 85, 92, 93, 107, 127, 132, 133, 135, 143, 145, 147, 162, 168, 187, 188, 189, 200, 205, 207, 208, 209, 210, 212, 220, 221, 222, 223, 225, 228, 236, 237, 238, 239, 241, 244, 245, 247, 257, 258, 260, 261, 262, 263, 265, 266, 283, 294, 300, 301, 307, 308, 318, 319, 334, 336, 339, 342, 344, 345, 346, 347, 355, 359, 361, 362, 363, 366, 368, 370, 373, 398, 404, 405, 406, 408, 412, 424, 427, 429, 431, 439, 441, 442, 446, 448, 449, 450, 454, 468, 470, 480, 481, 482, 485, 489, 490, 495, 497, 501, 504, 505, 506, 508, 511, 512, 514, 516, 523, 526, 527, 529, 533, 535, 536, 537, 538, 539, 540, 541, 542, 543, 544, 545, 546, 547, 548, 549, 552, 553, 554, 555, 556, 558, 559, 560, 565, 566, 567, 568, 570, 571, 573, 575, 577, 580, 581, 582, 583, 586, 589, 591, 592, 594, 596, 599, 601, 604, 609, 610, 615, 616, 620, 631, 632, 634, 639, 643, 644, 645, 646, 647, 648A, 649, 650, 652, 653, 654, 659, 661, 662, 663, 664, 665, 666, wherein the amino acid positions of the polypeptide sequence are numbered with reference to SEQ ID NO: 2.

In some embodiments, the one or more substitutions are at positions selected from 35, 75, 143, 205, 212, 236, 258, 261, 263, 266, 300, 301, 308, 339, 342, 346, 347, 370, 408, 431, 439, 441, 442, 446, 449, 450, 454, 468, 468, 470, 482, 489, 490, 505, 511, 514, 536, 537, 539, 545, 546, 568, 570, 581, 582, 615, 620, 620, 639, 639, 646, and 664. In some embodiments, the one or more substitutions are at positions selected from 35, 75, 143, 205, 212, 236, 258, 261, 263, 266, 300, 301, 308, 339, 347, 370, 408, 431, 439, 441, 442, 446, 449, 450, 454, 468, 470, 482, 489, 490, 505, 511, 514, 536, 537, 539, 545, 546, 568, 570, 582, 615, 620, 639, 646, and 664. In some embodiments, the one or more substitutions are at positions selected from 35, 143, 205, 236, 258, 261, 263, 266, 300, 301, 308, 339, 347, 370, 408, 439, 441, 442, 446, 449, 450, 454, 468, 470, 489, 490, 505, 511, 514, 536, 537, 539, 545, 546, 570, 582, 620, 639, 646, and 664. In some embodiments, the one or more substitutions are at positions selected from 35, 205, 236, 258, 261, 300, 301, 308, 339, 347, 370, 408, 439, 442, 446, 449L, 450, 468, 470, 489, 490, 505, 511, 514, 536, 537, 539, 545, 582, 620, 639, 646, and 664. In some embodiments, the one or more substitutions are at positions selected from 205, 236, 258, 261, 300, 301, 308, 339, 342, 346, 347, 370, 408, 439, 442, 446, 449, 450, 468, 490, 505, 514, 536, 537, 545, 620, 639, and 646. In some embodiments, the one or more substitutions are at positions selected from 205, 258, 261, 339, 342, 439, 442, 446, 449, 450, 505, 536, 545, 620, and 646. In some embodiments, the one or more substitutions are at positions selected from 205, 258, 261, 339, 342, 442, 446, 505, 536, 545, 620, and 646. In some embodiments, the one or more substitutions are at positions selected from 258, 261, 339, 342, and 446.

In some embodiments, the one or more substitutions are selected from 9K or Q; 17A; 29F, G, or S; 30G; 32A or T; 34M; 35D or G; 36D; 37L; 43P; 47G; 50S; 63E; 75N or S; 77D; 81N; 85L; 92L; 93E; 107K or T; 127S; 132T; 133M or V; 135E; 143H or Q; 145E; 147T; 162I; 168N; 187G; 188T or W; 189A, I, P, or Q; 200W; 205R, T, L, Q, or R; 207R; 208T; 209V; 210D; 212S; 220A; 221I; 222T; 223Q or R; 225A or K; 228I or V; 236V; 237E; 238I; 239K; 241P; 244K or S; 245S; 247S; 257L; 258G, H, N, K or R; 260D; 261 G, L, R, S, V, or D; 262L; 263T, H, I, M, S, T, or V; 265R; 266E, K, A, G, L, M, R, S. V, W, Y, or G; 283H, K or L; 294A; 300F; 301V; 307L; 308E; 318D; 319K or Q; 334I; 336W; 339N, F, M, S, or W; 342F, R, or F; 344V; 345 W, C, or P; 346K; 347F; 355C or R; 359Y; 361V; 362T; 363E, H, K, W, or Y; 366A, G, F, Q or S; 368M; 370C; 373F; 398G; 404G; 405R; 406R; 408R, or V; 412Y; 424G; 427R, H or F; 429F or P; 431T; 439M; 441E, A or V; 442F or S; 446A, G, F, M, R, T, V, or F; 448K, M, R or W; 449L, L, A; 450R or W; 454I, L, M, or S; 468S; 470G, or Q; 480L; 481S; 482S or V; 485D; 489E or Y; 490E; 495L; 497R; 501Q; 504P or V; 505A, F, G, or M; 506N or R; 508G; 511D or S; 512N; 514H; 516M; 523V; 526E, L, or V; 527E, A, D, L, M, R, T, or V; 529G; 533E, A, D, K, or N; 535R or V; 536E, D, G, H, R, V, or W; 537P; 538T; 539 E, L, or M; 540G; 541G, I, or R; 542L, M, S, or V; 543A, D, G, or V; 544L or R; 545I, R, or V; 546E, L, or R; 547E, A, or V; 548E, R, or S; 549G or T; 552N; 553R or T; 554M; 555 D, G, L, or Q; 556G or V; 558E or R; 559H or S; 560S; 565A, C, or D; 566G; 567R; 568P or R; 570E; 571I; 573T; 575G; 577V; 580C; 581C, L, R, T, or A; 582F, G, R, S, or V; 583E, R, or V; 586V; 589A; 591L, R, or V; 592P; 594A; 596T; 599L; 601I; 604P; 609G; 610L, P, R, or S; 615A, D, G, M, P, Q, T, or W; 616T 620L, Q, S, or V; 631W; 632Q; 634C; 639E, I, K, T, or V; 643E or R; 644A; 645E, G, S, or W; 646E, G, I, L, M, R, or V; 647L or W; 648A, Q, or V; 649H, T, or Y; 650G or T; 652I, L, Q, T, V, or Y; 653I; 654C or V; 659T; 661D; 662W; 663M or W; 664G, R, V, or W; 665E; and 666D, wherein the amino acid positions of the polypeptide sequence are numbered with reference to SEQ ID NO: 2.

In some embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises one or more substitutions selected from 9K or Q; 17A; 29F, G, or S; 30G; 32 A or T; 34M; 35D or G; 36D; 37L; 43P; 47G; 50S; 63E; 75N or S; 77D; 81N; 85L; 92L; 93E; 107K or T; 127S; 132T; 133M or V; 135E; 143H or Q; 145E; 147T; 162I; 168N; 187G; 188T or W; 189A, I, P, or Q; 200W; 205R, T, L, Q, or R; 207R; 208T; 209V; 210D; 212S; 220A; 221I; 222T; 223Q or R; 225A or K; 228I or V; 236V; 237E; 238I; 239K; 241P; 244K or S; 245S; 247S; 257L; 258G, H, N, K or R; 260D; 261 G, L, R, S, V, or D; 262L; 263T, H, I, M, S, T, or V; 265R; 266E, K, A, G, L, M, R, S. V, W, Y, or G; 283H, K or L; 294A; 300F; 301V; 307L; 308E; 318D; 319K or Q; 334I; 336W; 339N, F, M, S, or W; 342F, R, or L; 344V; 345 W, C, or P; 346K; 347F; 355C or R; 359Y; 361V; 362T; 363E, H, K, W, or Y; 366A, G, L, Q or S; 368M; 370C; 373F; 398G; 404G; 405R; 406R; 408R, or V; 412Y; 424G; 427R, H or L; 429L or P; 431T; 439M; 441E, A or V; 442L or S; 446A, G, L, M, R, T, V, or F; 448K, M, R or W; 449K, L, A; 450R or W; 454I, L, M, or S; 468S; 470G, or Q; 480L; 481S; 482S or V; 485D; 489E or Y; 490E; 495L; 497R; 501Q; 504P or V; 505A, F, G, or M; 506N or R; 508G; 511D or S; 512N; 514H; 516M; 523V; 526E, L, or V; 527E, A, D, L, M, R, T, or V; 529G; 533E, A, D, K, or N; 535R or V; 536E, D, G, H, R, V, or W; 537P; 538T; 539 E, L, or M; 540G; 541G, I, or R; 542L, M, S, or V; 543A, D, G, or V; 544L or R; 545I, R, or V; 546E, L, or R; 547E, A, or V; 548E, R, or S; 549G or T; 552N; 553R or T; 554M; 555 D, G, L, or Q; 556G or V; 558E or R; 559H or S; 560S; 565A, C, or D; 566G; 567R; 568P or R; 570E; 571I; 573T; 575G; 577V; 580C; 581C, L, R, T, or A; 582F, G, R, S, or V; 583E, R, or V; 586V; 589A; 591L, R, or V; 592P; 594A; 596T; 599L; 601I; 604P; 609G; 610L, P, R, or S; 615A, D, G, M, P, Q, T, or W; 616T 620L, Q, S, or V; 631W; 632Q; 634C; 639E, I, K, T, or V; 643E or R; 644A; 645E, G, S, or W; 646E, G, I, L, M, R, or V; 647L or W; 648A, Q, or V; 649H, T, or Y; 650G or T; 652I, L, Q, T, V, or Y; 653I; 654C or V; 659T; 661D; 662W; 663M or W; 664G, R, V, or W; 665E; and 666D, wherein the amino acid positions of the polypeptide sequence are numbered with reference to SEQ ID NO: 2.

In some embodiments, the recombinant protease and/or biologically active recombinant protease fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease and/or biologically active recombinant protease fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278, with the proviso that the recombinant protease does not have the polypeptide sequence of SEQ ID NO:2.

In some embodiments, the recombinant protease and/or biologically active recombinant protease fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278, and further comprises one or more substitutions. In some embodiments, the recombinant protease and/or biologically active recombinant protease fragment comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278, and further comprises one or more substitutions at positions selected from 9, 17, 29, 30, 32, 34, 35, 36, 37, 43, 47, 50, 63, 75, 77, 81, 85, 92, 93, 107, 127, 132, 133, 135, 143, 145, 147, 162, 168, 187, 188, 189, 200, 205, 207, 208, 209, 210, 212, 220, 221, 222, 223, 225, 228, 236, 237, 238, 239, 241, 244, 245, 247, 257, 258, 260, 261, 262, 263, 265, 266, 283, 294, 300, 301, 307, 308, 318, 319, 334, 336, 339, 342, 344, 345, 346, 347, 355, 359, 361, 362, 363, 366, 368, 370, 373, 398, 404, 405, 406, 408, 412, 424, 427, 429, 431, 439, 441, 442, 446, 448, 449, 450, 454, 468, 470, 480, 481, 482, 485, 489, 490, 495, 497, 501, 504, 505, 506, 508, 511, 512, 514, 516, 523, 526, 527, 529, 533, 535, 536E, 537, 538, 539, 540, 541, 542, 543, 544, 545, 546, 547, 548, 549, 552, 553, 554, 555, 556, 558, 559, 560, 565, 566, 567, 568, 570, 571, 573, 575, 577, 580, 581, 582, 583, 586, 589, 591, 592, 594, 596, 599, 601, 604, 609, 610, 615, 616, 620, 631, 632, 634, 639, 643, 644, 645, 646, 647, 648A, 649, 650, 652, 653, 654, 659, 661, 662, 663, 664, 665, or 666, wherein the amino acid positions of the polypeptide sequence are numbered with reference to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the amino acid substitutions described above for the positions can be used.

In some additional embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set at one or more positions selected from 236, 258, 261, 339, 439, 446, and 454, wherein the amino acid positions of the polypeptide sequence are numbered with reference to SEQ ID NO: 2. In some further embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from 236V, 258K, 261L, 339M, 339W, 439M, 446A, 446G, 446L, 446M, 446T, and 454L, wherein the amino acid positions of the polypeptide sequence are numbered with reference to SEQ ID NO: 2. In some further embodiments, the recombinant protease comprises a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from M236V, Q258K, E261L, N339M, N339W, S439M, P446A, P446G, P446L, P446M, P446T, and A454L, wherein the amino acid positions of the polypeptide sequence are numbered with reference to SEQ ID NO: 2.

In some additional embodiments, the recombinant protease comprises a polypeptide sequence having at least 70%, 75%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set at one or more positions selected from 107/536, 162/408, 168/547, 208/366/504/591, 208/485/526, 210/223/258/552, 210/241/258/599, 223/241/258/599, 223/429/481/533, 223/481/533/552, 225, 225/260/263/265/544, 225/262, 225/362/366/591, 225/366, 225/482/591, 244, 258, 258/318/429, 258/449/481, 258/481, 261, 261/504, 318/481, 318/533, 318/599, 339, 342, 345, 362/366/485/591, 363, 366, 366/485, 366/497, 366/526/591, 366/591, 408, 427, 446, 448, 449, 450, 481/533/552, 482, 482/485, 482/591, 485, 485/591, 533, 533/552, 536, 544, 547, 549, 565, 615, and 652, wherein the amino acid positions of the polypeptide sequence are numbered with reference to SEQ ID NO: 2. In some further embodiments, the recombinant protease comprises a polypeptide sequence having at least 70%, 75%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from 107T/536D, 162I/408R, 168N/547V, 208T/366G/504P/591L, 208T/485D/526L, 210D/223R/258K/552N, 210D/241P/258K/599L, 223R/241P/258K/599L, 223R/429L/481S/533K, 223R/481S/533K/552N, 225A/260D/263H/265R/544R, 225A/262L, 225A/362T/366G/591L, 225A/366G, 225A/482V/591L, 225K, 244K, 258K, 258K/318D/429L, 258K/449V/481S, 258K/481S, 258R, 261G, 261G/504V, 261L, 261R, 261S, 261V, 318D/481S, 318D/533K, 318D/599L, 339F, 339W, 342R, 345W, 362T/366G/485D/591L, 363E, 363W, 366A, 366G, 366G/485D, 366G/497R, 366G/526L/591L, 366G/591L, 366L, 366Q, 408R, 427H, 427R, 446R, 446V, 448K, 448R, 448W, 449K, 450W, 481S/533K/552N, 482V, 482V/485D, 482V/591L, 485D, 485D/591L, 533A, 533D, 533E, 533K, 533K/552N, 533N, 536E, 536G, 536V, 544R, 547A, 547E, 549T, 565C, 565D, 615A, 615D, 615G, 615P, 615T, 615W, and 652I, wherein the amino acid positions of the polypeptide sequence are numbered with reference to SEQ ID NO: 2. In some further embodiments, the recombinant protease comprises a polypeptide sequence having at least 70%, 75%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set selected from M107T/Q536D, T162I/A408R, S168N/Q547V, A208T/N366G/Q504P/K591L, A208T/N485D/R526L, N210D/N223R/Q258K/K552N, N210D/E241P/Q258K/D599L, N223R/E241P/Q258K/D599L, N223R/K429L/A481S/M533K, N223R/A481S/M533K/K552N, T225A/N260D/R263H/G265R/T544R, T225A/P262L, T225A/N362T/N366G/K591L, T225A/N366G, T225A/R482V/K591L, T225K, R244K, Q258K, Q258K/Q318D/K429L, Q258K/A449V/A481S, Q258K/A481S, Q258R, E261G, E261G/Q504V, E261L, E261R, E261S, E261V, Q318D/A481S, Q318D/M533K, Q318D/D599L, N339F, N339W, L342R, Q345W, N362T/N366G/N485D/K591L, Q363E, Q363W, N366A, N366G, N366G/N485D, N366G/Q497R, N366G/R526L/K591L, N366G/K591L, N366L, N366Q, A408R, P427H, P427R, P446R, P446V, N448K, N448R, N448W, A449K, N450W, A481S/M533K/K552N, R482V, R482V/N485D, R482V/K591L, N485D, N485D/K591L, M533A, M533D, M533E, M533K, M533K/K552N, M533N, Q536E, Q536G, Q536V, T544R, Q547A, Q547E, V549T, N565C, N565D, K615A, K615D, K615G, K615P, K615T, K615W, and K652I, wherein the amino acid positions of the polypeptide sequence are numbered with reference to SEQ ID NO: 2.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the recombinant protease comprises at least one substitution or substitution set at one or more positions selected from 258, 258/261/342/345, 258/261/342/504/533, 258/261/345/504/549, 258/261/482/504/549, 258/342, 258/342/504/533/536/549, 258/345/427, 258/408/427/504/549, 258/427, 258/427/482/504/533/536, 258/427/482/536, 261/342/345/536, 261/342/482/504/533/536, 261/342/482/504/549, 261/342/482/536, 261/342/533, 261/482, 318/339/362/544/547, 318/339/448/544, 318/339/547, 318/448/544/615, 339/362/363/544/547/615, 339/362/544, 339/448, 339/448/547, 339/544/547, 342, 342/408, 342/408/536, 342/482/536, 362/363/544/547, 362/448, 363/544/547, 427/482/504/533/536, 427/533/536/549, 448, 448/544, and 448/544/547/615, wherein the amino acid positions of the polypeptide sequence are numbered with reference to SEQ ID NO: 34. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the recombinant protease comprises at least one substitution or substitution set selected from 258K, 258K/261L/342R/345W, 258K/261L/342R/504P/533D, 258K/261L/345W/504P/549T, 258K/261R/482V/504P/549T, 258K/342R, 258K/342R/504P/533K/536E/549T, 258K/345W/427R, 258K/408R/427R/504P/549T, 258K/427R, 258K/427R/482V/504P/533K/536E, 258K/427R/482V/536E, 261L/342R/345W/536E, 261L/342R/482V/504P/533K/536E, 261L/342R/533D, 261R/342R/482V/504P/549T, 261R/342R/482V/536E, 261R/482V, 318D/339W/362T/544R/547E, 318D/339W/448R/544R, 318D/339W/547E, 318D/448R/544R/615A, 339W/362T/363E/544R/547E/615A, 339W/362T/544R, 339W/448K, 339W/448R, 339W/448R/547E, 339W/544R/547E, 342R, 342R/A408R, 342R/408R/536E, 342R/482V/536E, 362T/363E/544R/547E, 362T/448R, 363E/544R/547E, 427R/482V/504P/533D/536E, 427R/533K/536E/549T, 448R, 448R/544R, and 448R/544R/547E/615A, wherein the amino acid positions of the polypeptide sequence are numbered with reference to SEQ ID NO: 34. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the recombinant protease comprises at least one substitution or substitution set selected from Q258K, Q258K/E261L/L342R/Q345W, Q258K/E261L/L342R/Q504P/M533D, Q258K/E261L/Q345W/Q504P/V549T, Q258K/E261R/R482V/Q504P/V549T, Q258K/L342R, Q258K/L342R/Q504P/M533K/Q536E/V549T, Q258K/Q345W/P427R, Q258K/A408R/P427R/Q504P/V549T, Q258K/P427R, Q258K/P427R/R482V/Q504P/M533K/Q536E, Q258K/P427R/R482V/Q536E, E261L/L342R/Q345W/Q536E, E261L/L342R/R482V/Q504P/M533K/Q536E, E261L/L342R/M533D, E261R/L342R/R482V/Q504P/V549T, E261R/L342R/R482V/Q536E, E261R/R482V, Q318D/N339W/N362T/T544R/Q547E, Q318D/N339W/N448R/T544R, Q318D/N339W/Q547E, Q318D/N448R/T544R/K615A, N339W/N362T/Q363E/T544R/Q547E/K615A, N339W/N362T/T544R, N339W/N448K, N339W/N448R, N339W/N448R/Q547E, N339W/T544R/Q547E, L342R, L342R/A408R, L342R/A408R/Q536E, L342R/R482V/Q536E, N362T/Q363E/T544R/Q547E, N362T/N448R, Q363E/T544R/Q547E, P427R/R482V/Q504P/M533D/Q536E, P427R/M533K/Q536E/V549T, N448R, N448R/T544R, and N448R/T544R/Q547E/K615A, wherein the amino acid positions of the polypeptide sequence are numbered with reference to SEQ ID NO: 34.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set at one or more positions selected from 205, 505, 541, 556, and 646, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from 205Q, 205T, 505A, 541R, 556V, 646L, and 646V, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from S205Q, S205T, Q505A, S541R, T556V, A646L, and A646V, wherein the amino acid positions of the polypeptide sequence are numbered with reference to SEQ ID NO: 190.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set at one or more positions selected from 205, 220, 239, 261, 261/339, 261/339/547, 261/536, 261/536/547, 339/427/536, 339/427/536/547, 339/427/547, 405, 442, 505, 539, 541, 542, 545, 556, 558, 594, 631, 663, and 665, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from 205R, 220A, 239K, 261L, 261L/339S/547E, 261L/339W, 261L/536W, 261L/536W/547E, 339W/427R/536W, 339W/427R/536W/547E, 339W/427R/547E, 405R, 442L, 442S, 505G, 539*, 541G, 541I, 542*, 545*, 545I, 545R, 556*, 558E, 594A, 631W, 663*, 663M, and 665E, wherein the amino acid positions of the polypeptide sequence are numbered with reference to SEQ ID NO: 190. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the recombinant protease comprises at least one substitution or substitution set selected from S205R, S220A, D239K, E261L, E261L/N339S/Q547E, E261L/N339W, E261L/Q536W, E261L/Q536W/Q547E, N339W/P427R/Q536W, N339W/P427R/Q536W/Q547E, N339W/P427R/Q547E, V405R, V442L, V442S, Q505G, P539*, S541G, S541I, I542*, A545*, A545I, A545R, T556*, T558E, V594A, G631W, E663*, E663M, and P665E, wherein the amino acid positions of the polypeptide sequence are numbered with reference to SEQ ID NO: 190.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the recombinant protease comprises at least one substitution or substitution set at one or more positions selected from 205/442/505/536/545/620/646, 205/505/536/541/545/547/558/646/665, 258, 263, 355/536/545/547, 359, 366, 446, 449, 505/536/545/558/646, 506, 555, 556, 620, and 650, wherein the amino acid positions of the polypeptide sequence are numbered with reference to SEQ ID NO: 292. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the recombinant protease comprises at least one substitution or substitution set selected from 205R/442L/505A/536W/545E620V/646V, 205R/505A/536W/541E545R/547E/558E/646V/665E, 258G, 263M, 263S, 355R/536W/545I/547E, 359Y, 366S, 446P, 449L, 505A/536W/545I/558E/646V, 506R, 555D, 555G, 555L, 556G, 620L, 620Q, 620S, and 650T, wherein the amino acid positions of the polypeptide sequence are numbered with reference to SEQ ID NO: 292. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the recombinant protease comprises at least one substitution or substitution set selected from S205R/V442L/Q505A/Q536W/A545I/E620V/A646V, S205R/Q505A/Q536W/S541I/A545R/Q547E/T558E/A646V/P665E, K258G, R263M, R263S, L355R/Q536W/A545I/Q547E, F359Y, N366S, R446P, A449L, Q505A/Q536W/A545I/T558E/A646V, G506R, E555D, E555G, E555L, T556G, E620L, E620Q, E620S, and I650T, wherein the amino acid positions of the polypeptide sequence are numbered with reference to SEQ ID NO: 292.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the recombinant protease comprises at least one substitution or substitution set at one or more positions selected from 283/319/359/449/450/506, 283/345/359/449/450/553/555, 283/449/450/508/541/553/555, 449/450, 450/508/553/555/558, 508, and 508/541/553, wherein the amino acid positions of the polypeptide sequence are numbered with reference to SEQ ID NO: 342. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the recombinant protease comprises at least one substitution or substitution set selected from 283H/345C/359Y/449L/450R/553T/555G, 283L/319K/359Y/449L/450R/506R, 283L/449L/450R/508G/541E553T/555G, 449L/450R, 450R/508G/553R/555G/558E, 508G, and 508G/541I/553T, wherein the amino acid positions of the polypeptide sequence are numbered with reference to SEQ ID NO: 342. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the recombinant protease comprises at least one substitution or substitution set selected from N283H/Q345C/F359Y/A449L/N450R/D553T/E555G, N283L/N319K/F359Y/A449L/N450R/G506R, N283L/A449L/N450R/N508G/S541I/D553T/E555G, A449L/N450R, N450R/N508G/D553R/E555G/T558E, N508G, and N508G/S541I/D553T, wherein the amino acid positions of the polypeptide sequence are numbered with reference to SEQ ID NO: 342.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the recombinant protease comprises at least one substitution or substitution set at one or more positions selected from 205, 205/442/449/450, 205/450/536/545, 205/450/536/545/646, 258/442/446, 258/442/449/646, 258/450/536/545, 308, 361, 439, 442/446/536/545/620/646, 442/450/536/545, 514, 535, 577, 591, 592, 610, 639, 643, and 644, wherein the amino acid positions of the polypeptide sequence are numbered with reference to SEQ ID NO: 396 or 1366. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the recombinant protease comprises at least one substitution or substitution set selected from 205S, 205S/442V/449A/450N, 205S/450N/536Q/545A, 205S/450N/536Q/545A/646A, 258Q/442V/446P, 258Q/442V/449A/646A, 258Q/450N/536Q/545A, 308E, 361V, 439M, 442V/446P/536Q/545A/620E/646A, 442V/450N/536Q/

545A, 514H, 535R, 535V, 577V, 591R, 591V, 592P, 610L, 610P, 610S, 639E, 639K, 643E, 643R, and 644A, wherein the amino acid positions of the polypeptide sequence are numbered with reference to SEQ ID NO: 396 or 1366. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the recombinant protease comprises at least one substitution or substitution set selected from R205S, R205S/L442V/L449A/R450N, R205S/R450N/W536Q/I545A, R205S/R450N/W536Q/I545A/V646A, K258Q/L442V/R446P, K258Q/L442V/L449A/V646A, K258Q/R450N/W536Q/I545A, A308E, I361V, S439M, L442V/R446P/W536Q/I545A/V620E/V646A, L442V/R450N/W536Q/I545A, R514H, E535R, E535V, D577V, K591R, K591V, A592P, A610L, A610P, A610S, A639E, A639K, A643E, A643R, and D644A, wherein the amino acid positions of the polypeptide sequence are numbered with reference to SEQ ID NO: 396 or 1366.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 400 or 1370, or a functional fragment thereof, and wherein the recombinant protease comprises at least one substitution or substitution set at one or more positions selected from 32/490/639, 236, 236/238/404/480/555/568/592, 236/359/404/406/555/639, 236/359/490/581/639, 236/359/555, 236/359/609, 236/370/406/568/581, 236/370/568/592, 236/370/581, 236/404/406/480/490, 236/404/555/581/609/639, 236/568, 236/592, 236/639, 238/359/370/404/490/568/639, 245/363/408/512/514/596/666, 245/363/512/514/537/560, 308/514/535/639/644, 359/404, 359/404/406/490/546/581, 363/408/512/514/537, 363/408/601/650, 363/639/644, 408/512, 408/514/537, 408/514/560/650, 490/568/592/639, 512/537/560/601, 514/535/546/575/644, 514/639/644, 514/644, 535/575/639/644, 535/639/643/644, 535/643/644, and 601/650, wherein the amino acid positions of the polypeptide sequence are numbered with reference to SEQ ID NO: 400 or 1370. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 400 or 1370, or a functional fragment thereof, and wherein the recombinant protease comprises at least one substitution or substitution set selected from 32T/490E/639T, 236V, 236V/238I/404G/480L/555Q/568P/592P, 236V/359Y/404G/406R/555Q/639T, 236V/359Y/490E/581T/639T, 236V/359Y/555Q, 236V/359Y/609G, 236V/370C/406R/568P/581T, 236V/370C/568P/592P, 236V/370C/581T, 236V/404G/406R/480L/490E, 236V/404G/555Q/581T/609G/639T, 236V/568P, 236V/592P, 236V/639T, 238I/359Y/370C/404G/490E/568 P/639T, 245S/363K/408V/512N/514H/596T/666D, 245S/363K/512N/514H/537P/560S, 308E/514H/535R/639K/644A, 359Y/404G, 359Y/404G/406R/490E/546E/581T, 363H/639K/644A, 363K/408V/512N/514H/537P, 363K/408V/601E650T, 408V/512N, 408V/514H/537P, 408V/514H/560S/650T, 490E/568P/592P/639T, 512N/537P/560S/601I, 514H/535R/546E/575G/644A, 514H/639K/644A, 514H/644A, 535R/575G/639K/644A, 535R/639K/643R/644A, 535V/643R/644A, and 601I/650T, wherein the amino acid positions of the polypeptide sequence are numbered with reference to SEQ ID NO: 400 or 1370. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 400 or 1370, or a functional fragment thereof, and wherein the recombinant protease comprises at least one substitution or substitution set selected from I32T/Q490E/A639T, M236V, M236V/L238I/S404G/I480L/E555Q/L568P/A592P, M236V/F359Y/S404G/K406R/E555Q/A639T, M236V/F359Y/Q490E/S581T/A639T, M236V/F359Y/E555Q, M236V/F359Y/A609G, M236V/S370C/K406R/L568P/S581T, M236V/S370C/L568P/A592P, M236V/S370C/S581T, M236V/S404G/K406R/I480L/Q490E, M236V/S404G/E555Q/S581T/A609G/A639T, M236V/L568P, M236V/A592P, M236V/A639T, L238I/F359Y/S370C/S404G/Q490E/L568P/A639T, T245S/Q363K/A408V/S512N/R514H/M596T/S666D, T245S/Q363K/S512N/R514H/E537P/T560S, A308E/R514H/E535R/A639K/D644A, F359Y/S404G, F359Y/S404G/K406R/Q490E/V546E/S581T, Q363H/A639K/D644A, Q363K/A408V/S512N/R514H/E537P, Q363K/A408V/M601I/I650T, A408V/S512N, A408V/R514H/E537P, A408V/R514H/T560S/I650T, Q490E/L568P/A592P/A639T, S512N/E537P/T560S/M601I, R514H/E535R/V546E/S575G/D644A, R514H/A639K/D644A, R514H/D644A, E535R/S575G/A639K/D644A, E535R/A639K/A643R/D644A, E535V/A643R/D644A, and M601I/I650T, wherein the amino acid positions of the polypeptide sequence are numbered with reference to SEQ ID NO: 400 or 1370.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 454 or 1424, or a functional fragment thereof, and wherein the recombinant protease comprises at least one substitution or substitution set at one or more positions selected from 236, 236/308/370/548, 236/308/490/581/643, 236/308/555/560/596, 236/370, 236/370/490/639, 236/555, 236/560/581, 245/359/363/406/535/650, 245/363/406/575/601/666, 300, 301, 308, 308/490/560/581/639/643, 336, 359/363/406/535/601/650, 359/404/406/535, 359/406/575/650/666, 359/535/575/601, 363/404/406/535/568, 404/406/535, 406, 406/480/535/568/601, 406/535/575, 468, and 480/575/601/650, wherein the amino acid positions of the polypeptide sequence are numbered with reference to SEQ ID NO: 454 or 1424. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 454 or 1424, or a functional fragment thereof, and wherein the recombinant protease comprises at least one substitution or substitution set selected from 236V, 236V/308E/370C/548E, 236V/308E/490E/581T/643R, 236V/308E/555Q/560S/596T, 236V/370C, 236V/370C/490E/639T, 236V/555Q, 236V/560S/581T, 245S/359Y/363K/406R/535R/650T, 245S/363K/406R/575G/601I/666D, 300F, 301V, 308E, 308E/490E/560S/581T/639T/643R, 336W, 359Y/363K/406R/535R/601I/650T, 359Y/404G/406R/535R, 359Y/406R/575G/650T/666D, 359Y/535R/575G/601I, 363K/404G/406R/535R/568P, 404G/406R/535R, 406R, 406R/480L/535R/568P/601I, 406R/535R/575G, 468S, and 480L/575G/601I/650T, wherein the amino acid positions of the polypeptide sequence are numbered with reference to SEQ ID NO: 454 or 1424. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 454 or 1424, or a functional fragment thereof, and wherein the recombinant protease comprises at least one substitution or substitution set selected from M236V, M236V/A308E/S370C/D548E, M236V/A308E/Q490E/S581T/A643R, M236V/A308E/E555Q/T560S/M596T, M236V/S370C, M236V/S370C/Q490E/A639T, M236V/E555Q, M236V/T560S/S581T, T245S/F359Y/Q363K/K406R/E535R/I650T, T245S/Q363K/K406R/S575G/M601I/S666D, L300F, A301V, A308E, A308E/Q490E/T560S/S581T/A639T/A643R, Y336W, F359Y/Q363K/K406R/E535R/M601I/I650T, F359Y/S404G/K406R/E535R, F359Y/K406R/S575G/I650T/S666D, F359Y/E535R/S575G/M601I, Q363K/S404G/K406R/E535R/L568P, S404G/K406R/E535R, K406R, K406R/I480L/E535R/L568P/M601I, K406R/E535R/S575G, A468S, and I480L/S575G/M601I/I650T, wherein the amino acid positions of the polypeptide sequence are numbered with reference to SEQ ID NO: 454 or 1424.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set at one or more positions selected from 133/301/346/347/468, 205/236/347, 205/236/370/490/537/620, 205/342/439/442/514/620/639, 205/370/537, 205/442/505/620, 236/258/370/505/545/639, 236/339/514, 236/370/450/620, 236/545, 258/339/342/505/537, 258/342/370/408/442/537, 300/301/308/346/347/468, 300/301/347/468, 301/308/336/346/406/468/601, 301/308/346/406/468, 301/308/468/601, 301/347/406, 308/336/347/468, 308/347/468, 342, 342/408/490/505/514/545/639/646, 342/620, 370/442, 370/537/639, 489, 539/649, 542, 543, 543/673, 558, 559, 566, 634, and 661, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from 133M/301V/346K/347F/468S, 205S/236M/347F, 205S/236M/370S/490Q/537E/620E, 205S/342L/439S/442V/514R/620E/639A, 205S/370S/537E, 205S/442V/505Q/620E, 236M/258Q/370S/505Q/545A/639A, 236M/339N/514R, 236M/370S/450N/620E, 236M/545A, 258Q/339N/342L/505Q/537E, 258Q/342L/370S/408A/442V/537E, 300F/301V/308E/346K/347F/468S, 300F/301V/347F/468S, 301V/308E/336W/346K/406R/468S/601I, 301V/308E/346K/406R/468S, 301V/308E/468S/601I, 301V/347F/406R, 308E/336W/347F/468S, 308E/347F/468S, 342L, 342L/408A/490Q/505Q/514R/545A/639A/646A, 342L/620E, 370S/442V, 370S/537E/639A, 489Y, 539M/649H, 542M, 543A, 543V/673Y, 558R, 559H, 559S, 566G, 634C, and 661D, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from L133M/A301V/V346K/V347F/A468S, R205S/V236M/V347F, R205S/V236M/C370S/E490Q/P537E/V620E, R205S/R342L/M439S/L442V/H514R/V620E/T639A, R205S/C370S/P537E, R205S/L442V/A505Q/V620E, V236M/K258Q/C370S/A505Q/I545A/T639A, V236M/W339N/H514R, V236M/C370S/R450N/V620E, V236M/I545A, K258Q/W339N/R342L/A505Q/P537E, K258Q/R342L/C370S/V408A/L442V/P537E, L300F/A301V/A308E/V346K/V347F/A468S, L300F/A301V/V347F/A468S, A301V/A308E/Y336W/V346K/K406R/A468S/M601I, A301V/A308E/V346K/K406R/A468S, A301V/A308E/A468S/M601I, A301V/V347F/K406R, A308E/Y336W/V347F/A468S, A308E/V347F/A468S, R342L, R342L/V408A/E490Q/A505Q/H514R/I545A/T639A/V646A, R342L/V620E, C370S/L442V, C370S/P537E/T639A, D489Y, P539M/D649H, I542M, F543A, F543V/H673Y, T558R, L559H, L559S, T566G, P634C, and G661D, wherein the amino acid positions of the polypeptide sequence are numbered with reference to SEQ ID NO: 562 or 1532.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set at one or more positions selected from 205/236/342/439/505/514/537/545, 236/342/505/514/537/545, 300/301/308/336/347/468/601, 300/301/347/406, 301/308/346/347/468, 301/336/346/347/406/601, and 308/336/347/406/468/601, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from 205S/236M/342L/439S/505Q/514R/537E/545A, 236M/342L/505Q/514R/537E/545A, 300F/301V/308E/336W/347F/468S/601I, 300F/301V/347F/406R, 301V/308E/346K/347F/468S, 301V/336W/346K/347F/406R/601I, and 308E/336W/347F/406R/468S/601I, wherein the amino acid positions of the polypeptide sequence are numbered with reference to SEQ ID NO: 562 or 1532. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the recombinant protease comprises at least one substitution or substitution set selected from R205S/V236M/R342L/M439S/A505Q/H514R/P537E/I545A, V236M/R342L/A505Q/H514R/P537E/I545A, L300F/A301V/A308E/Y336W/V347F/A468S/M601I, L300F/A301V/V347F/K406R, A301V/A308E/V346K/V347F/A468S, A301V/Y336W/V346K/V347F/K406R/M601I, and A308E/Y336W/V347F/K406R/A468S/M601I, wherein the amino acid positions of the polypeptide sequence are numbered with reference to SEQ ID NO: 562 or 1532.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set at one or more positions selected from 346/511/537, 346/511/537/541/543, 346/511/542/582, 346/511/581/582, 346/511/583, 346/529/571/581/582/583/589, 511/537, 516/539/568, 537/582, 539, 568/662/663, and 581/582, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from 346V/511S/537E, 346V/511S/537E/541I/543G, 346V/511S/542S/582R, 346V/511S/581L/582R, 346V/511S/583R, 346V/529G/571I/581C/582V/583V/589A, 511S/537E, 516M/539E/568R, 537E/582R, 539E, 568R/662W/663W, and 581L/582R, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from K346V/A511S/P537E, K346V/A511S/P537E/S541I/F543G, K346V/A511S/I542S/Y582R, K346V/A511S/S581L/Y582R, K346V/A511S/I583R, K346V/V529G/S571I/S581C/Y582V/I583V/T589A, A511S/P537E, P516M/P539E/L568R, P537E/Y582R, P539E, L568R/F662W/E663W, and S581L/Y582R, wherein the amino acid positions of the polypeptide sequence are numbered with reference to SEQ ID NO: 638 or 1608.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set at one or more positions selected from 346/511/537/582, 346/511/543/582, 346/511/544, 346/537/542/544, 346/543/544, 346/583, 511/537/542/582/583, 516, 516/539/555, 537/543/582, 539/568, 540, 542/544/581, 548, 549, 559, 559/568, 582, 647, 650, and 664, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from 346V/511S/537E/582V, 346V/511S/543G/582R, 346V/511S/544L, 346V/537E/542S/544L, 346V/543G/544L, 346V/583R, 511S/537E/542S/582R/583R, 516M, 516M/539E/555G, 537E/543G/582R, 539E/568R, 540G, 542S/544L/581R, 548R, 549G, 559S, 559S/568R, 582V, 647L, 647W, 650G, and 664R, wherein the amino acid positions of the polypeptide sequence are numbered with reference to SEQ ID NO: 638 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the recombinant protease comprises at least one substitution or substitution set selected from K346V/A511S/P537E/Y582V, K346V/A511S/F543G/Y582R, K346V/A511S/T544L, K346V/P537E/I542S/T544L, K346V/F543G/T544L, K346V/I583R, A511S/P537E/I542S/Y582R/I583R, P516M, P516M/P539E/E555G, P537E/F543G/Y582R, P539E/L568R, V540G, I542S/T544L/S581R, D548R, V549G, L559S, L559S/L568R, Y582V, Q647L, Q647W, I650G, and Q664R, wherein the amino acid positions of the polypeptide sequence are numbered with reference to SEQ ID NO: 638 or 1608.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680, or a functional fragment thereof, and wherein the recombinant protease comprises at least one substitution or substitution set at one or more positions selected from 261/355/543, 261/355/567/568, 261/489, 261/489/511/568, 261/489/539, 261/489/567, 261/539/543, 261/539/543/567, 261/542/543/568, 511, 511/539/543, 511/567, 543, and 583, wherein the amino acid positions of the polypeptide sequence are numbered with reference to SEQ ID NO: 680 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680 or 1608, or a functional fragment thereof, and wherein the recombinant protease comprises at least one substitution or substitution set selected from 261D/355C/543A, 261D/355C/567R/568R, 261D/489E, 261D/489E/511/568R, 261D/489E/539L, 261D/489E/567R, 261D/539L/543A, 261D/539L/543D/567R, 261D/542L/543A/568R, 511D, 511D/539L/543A, 511D/567R, 543A, and 583E, wherein the amino acid positions of the polypeptide sequence are numbered with reference to SEQ ID NO: 680 or 1608. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680 or 1608, or a functional fragment thereof, and wherein the recombinant protease comprises at least one substitution or substitution set selected from L261D/L355C/F543A, L261D/L355C/D567R/L568R, L261D/D489E, L261D/D489E/A511D/L568R, L261D/D489E/P539L, L261D/D489E/D567R, L261D/P539L/F543A, L261D/P539L/F543D/D567R, L261D/I542L/F543A/L568R, A511D, A511D/P539L/F543A, A511D/D567R, F543A, and I583E, wherein the amino acid positions of the polypeptide sequence are numbered with reference to SEQ ID NO: 680 or 1608.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set at one or more positions selected from 9, 9/17/34/35/93/554, 9/17/50, 9/17/93, 9/29/35/43/77/542/554, 9/32/77/93, 9/43/77, 9/50/63/93, 9/93, 17/29/34/35/36/77/93, 17/32/34/35, 17/77, 32/34/93, 43, 50/77/93, 50/93, 77/93, 93, 205/263/470, 205/344/470/565, 205/345/470/538/664, 205/470/545/568/645/647/664, 205/

470/567/568/645, 263/344/664, 263/470/645, 263/489, 263/ 539/541/568/645, 344/355/470/489/645, 344/355/470/568/ 645/647, 344/470/489/539/542/645/647/664, 344/470/489/ 567/568, 344/470/568, 344/470/647, 470, 470/489, 470/541/ 542/543/565/645/647, 470/567/568, 470/664, and 542/543, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from 9K, 9K/17A/34M/35G/93E/554M, 9K/17A/50S, 9K/17A/93E, 9K/29S/35G/43P/77D/542V/554M, 9K/32A/77D/93E, 9K/43P/77D, 9K/50S/63E/93E, 9K/93E, 9Q/17A/93E, 17A/ 29S/34M/35G/36D/77D/93E, 17A/32A/34M/35G, 17A/ 77D, 32A/34M/93E, 43P, 50S/77D/93E, 50S/93E, 77D/93E, 93E, 205L/263V/470Q, 205L/344V/470Q/565A, 205L/ 345P/470Q/538T/664R, 205L/470Q/545L/568R/645S/ 647W/664R, 205L/470Q/567R/568R/645S, 263I/344V/ 664R, 263E470Q/645S, 263I/489D, 263I/539L/541R/568R/ 645S, 344V/355C/470Q/489D/645S, 344V/355C/470Q/ 568R/645S/647W, 344V/470Q/489D/539L/542L/645S/ 647W/664R, 344V/470Q/489D/567R/568R, 344V/470Q/ 568R, 344V/470Q/647W, 470Q, 470Q/489D, 470Q/541R/ 542L/543A/565A/645S/647W, 470Q/567R/568R, 470Q/ 664R, and 542L/543A, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from R9K, R9K/T17A/T34M/E35G/A93E/ L554M, R9K/T17A/N50S, R9K/T17A/A93E, R9K/N29S/ E35G/S43P/N77D/I542V/L554M, R9K/I32A/N77D/A93E, R9K/S43P/N77D, R9K/N50S/A63E/A93E, R9K/A93E, R9Q/T17A/A93E, T17A/N29S/T34M/E35G/T36D/N77D/ A93E, T17A/I32A/T34M/E35G, T17A/N77D, I32A/T34M/ A93E, S43P, N50S/N77D/A93E, N50S/A93E, N77D/A93E, A93E, R205L/R263V/P470Q, R205L/N344V/P470Q/ N565A, R205L/Q345P/P470Q/S538T/Q664R, R205L/ P470Q/I545L/L568R/K645S/Q647W/Q664R, R205L/ P470Q/D567R/L568R/K645S, R263I/N344V/Q664R, R263I/P470Q/K645S, R263I/E489D, R263I/P539L/S541R/ L568R/K645S, N344V/L355C/P470Q/E489D/K645S, N344V/L355C/P470Q/L568R/K645S/Q647W, N344V/ P470Q/E489D/P539L/I542L/K645S/Q647W/Q664R, N344V/P470Q/E489D/D567R/L568R, N344V/P470Q/ L568R, N344V/P470Q/Q647W, P470Q, P470Q/E489D, P470Q/S541R/I542L/F543A/N565A/K645S/Q647W, P470Q/D567R/L568R, P470Q/Q664R, and I542L/F543A, wherein the amino acid positions of the polypeptide sequence are numbered with reference to SEQ ID NO: 756 or 1726.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set at one or more positions selected from 9/17/32/34/36/50/77/107/127, 9/17/63/77, 9/43/93/127, 9/63/93/107, 17/29/32/34/36/63, 29/34/35/77, 32/43/93, 35/93/145, and 205/263/489/647, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from 9K/17A/32A/34M/36D/50S/ 77D/107K/127S, 9K/17A/63E/77D, 9K/43P/93E/127S, 9K/63E/93E/107K, 17A/29S/32A/34M/36D/63E, 29S/ 34M/35G/77D, 32A/43P/93E, 35G/93E/145E, and 205L/ 263V/489D/647W, wherein the amino acid positions of the polypeptide sequence are numbered with reference to SEQ ID NO: 756 or 1726. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the recombinant protease comprises at least one substitution or substitution set selected from R9K/T17A/I32A/T34M/T36D/N50S/ N77D/M107K/G127S, R9K/T17A/A63E/N77D, R9K/ S43P/A93E/G127S, R9K/A63E/A93E/M107K, T17A/ N29S/I32A/T34M/T36D/A63E, N29S/T34M/E35G/N77D, I32A/S43P/A93E, E35G/A93E/G145E, and R205L/R263V/ E489D/Q647W, wherein the amino acid positions of the polypeptide sequence are numbered with reference to SEQ ID NO: 756 or 1726.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 188, 189, 265, 266, 334, 442, 454, 646, and 649, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from 188W, 189A, 189P, 265R, 266E, 266G, 334I, 442V, 454L, 454M, 454S, 646I, 646M, 646R, 649T, and 649Y, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from N188W, K189A, K189P, G265R, N266E, N266G, V334I, L442V, A454L, A454M, A454S, V646I, V646M, V646R, D649T, and D649Y, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 189, 266, 266/283, 546, 594, and 646, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from 189I, 266A, 266L, 266L/283K, 266M, 266S, 266V, 266W, 266Y, 546L, 594A, and 646L, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from K189I, N266A, N266L, N266L/N283K, N266M, N266S, N266V, N266W, N266Y, V546L, V594A, and V646L, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 263/470/568, 266, 470/542/543/664, and 558/577/594, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from 263I/470P/568R, 266R, 470P/542L/543A/664Q, and 558E/577V/594A, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set at one or more positions selected from 29, 29/35, 29/35/342/581/582/664, 29/50/511/539/581, 35, 35/50/205/406/511/581, 35/205/511, 35/342/346/511/539/581, 35/346, 35/346/406/511/581/582/664, 35/511, 35/539, 50/342, 132, 133, 143, 147, 187, 188, 257, 258, 263, 294, 294/441/527, 308/342/511/581/582, 342, 346, 398, 406/664, 429/652, 441, 441/446/526, 446/652, 482, 505, 511, 526, 527, 536, 545, 581, 582, 615, 620, 639, 645, 646, 648, 652, 654, and 664, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from 29F, 29G, 29S/35G, 29S/35G/342L/581S/582Y/664Q, 29S/50S/511S/539L/581S, 35D/511S, 35G, 35G/50S/205S/406R/511S/581S, 35G/205S/511S, 35G/342L/346V/511S/539L/581S, 35G/346V, 35G/346V/406R/511S/581S/582Y/664Q, 35G/511S, 35G/539L, 50S/342L, 132T, 133V, 143H, 147T, 187G, 188T, 257L, 258H, 258N, 263S, 294A, 294A/441A/527A, 308A/342L/511S/581S/582Y, 342F, 346V, 398G, 406R/664Q, 429L/652T, 441A, 441A/446P/526L, 441V, 446P/652T, 482V, 505F, 505M, 511S, 526V, 527D, 527R, 536H, 536R, 545V, 581A, 581S, 582G, 582S, 582Y, 615Q, 620E, 639E, 639I, 645E, 645G, 645W, 646G, 646R, 648Q, 648V, 652L, 652Q, 652T, 652Y, 654C, 664G, 664V, and 664W, wherein the amino acid positions of the polypeptide sequence are numbered with reference to SEQ ID NO: 812 or 1782. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the recombinant protease comprises at least one substitution or substitution set selected from N29F, N29G, N29S/E35G, N29S/E35G/R342L/L581S/R582Y/R664Q, N29S/N50S/A511S/P539L/L581S, E35D/A511S, E35G, E35G/N50S/R205S/K406R/A511S/L581S, E35G/R205S/A511S, E35G/R342L/K346V/A511S/P539L/L581S, E35G/K346V, E35G/K346V/K406R/A511S/L581S/R582Y/R664Q, E35G/A511S, E35G/P539L, N50S/R342L, I132T, L133V, E143H, A147T, I187G, N188T, R257L, K258H, K258N, R263S, R294A, R294A/R441A/K527A, E308A/R342L/A511S/L581S/R582Y, R342F, K346V, A398G, K406R/R664Q, K429L/K652T, R441A, R441A/R446P/K526L, R441V, R446P/K652T, R482V, A505F, A505M, A511S, R526V, K527D, K527R, W536H, W536R, I545V, L581A, L581S, R582G, R582S, R582Y, K615Q, V620E, T639E, T639I, K645E, K645G, K645W, V646G, V646R, R648Q, R648V, K652L, K652Q, K652T, K652Y, R654C, R664G, R664V, and R664W, wherein the amino acid positions of the polypeptide sequence are numbered with reference to SEQ ID NO: 812 or 1782.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the recombinant protease comprises at least one substitution or substitution set at one or more positions selected from 29, 29/143/263/266/441/639, 29/263/266, 29/263/266/441/620, 29/266/441, 29/441/639, 30, 37, 47/570, 75, 81, 85, 92, 135, 143, 143/263/266/639, 143/266/441/620/639, 168, 189/424, 237/527, 244, 258/342/582/648, 263, 263/266/441, 263/266/639, 266/441, 266/441/620/639, 266/620/639, 266/639, 267, 342/526/664, 342/545, 342/582, 429, 441, 482, 495, 501, 523, 526, 527, 568, 570, 573, 581, 582, 616, 632, 648, 653, and 654, wherein the amino acid positions of the polypeptide sequence are numbered with reference to SEQ ID NO: 1030 or 2000. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the recombinant protease comprises at least one substitution or substitution set selected from 29G/143H/263S/266A/441V/639I, 29G/263S/266A, 29G/263S/266L/441A/620E, 29G/266A/441A, 29G/441V/639V, 29S, 30G, 37L, 47G/570E, 75N, 75S, 81N, 85L, 92L, 135E, 143H/263S/266A/639V, 143H/266A/441V/620E/639V, 143Q, 168E, 189Q/424G, 237E/527V, 244S, 258H/342F/582S/648Q, 263S/266A/441A, 263S/266A/441V, 263S/266A/639V, 263T, 266A/441V/620E/639V, 266A/620E/639I, 266A/639I, 266L/441A, 267G, 342F/526V/664G, 342F/545V, 342F/582G, 429P, 441E, 482V, 495L, 501Q, 523V, 526E, 527E, 527L, 527M, 527R, 527T, 568P, 570E, 573T, 581T, 582F, 616T, 632Q, 648A, 653I, and 654V, wherein the amino acid positions of the polypeptide sequence are numbered with reference to SEQ ID NO: 1030 or 2000. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the recombinant protease comprises at least one substitution or substitution set selected from N29G/E143H/R263S/N266A/R441V/T639I, N29G/R263S/N266A, N29G/R263S/N266L/R441A/V620E, N29G/N266A/R441A, N29G/R441V/T639V, N29S, R30G, R37L, E47G/K570E, R75N, R75S, R81N, R85L, P92L, R135E, E143H/R263S/N266A/T639V, E143H/N266A/R441V/V620E/T639V, E143Q, S168E, K189Q/D424G, D237E/K527V, R244S, K258H/L342F/R582S/R648Q, R263S/N266A/R441A, R263S/N266A/R441V, R263S/N266A/T639V, R263T, N266A/R441V/V620E/T639V, N266A/V620E/T639I, N266A/T639I, N266L/R441A, R267G, L342F/R526V/R664G, L342F/I545V, L342F/R582G, K429P, R441E, R482V, I495L, R501Q, M523V, R526E, K527E, K527L, K527M, K527R, K527T, L568P, K570E, K573T, S581T, R582F, K616T, K632Q, R648A, M653I, and R654V, wherein the amino acid positions of the polypeptide sequence are numbered with reference to SEQ ID NO: 1030 or 2000.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set at one or more positions selected from 29, 29/30, 29/30/143/263/482/646, 29/30/263, 29/30/616/648, 29/75/263/568/570/648, 29/168/648, 29/263/527/568, 75, 75/143/168/527, 75/168, 75/616, 143, 168/247/482/648, 168/263/616, 168/482/616, 168/495/616, 263, 263/616, 429/545, 495, and 527, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from 29S, 29S/30G, 29S/30G/143Q/263T/482V/646E, 29S/30G/263T, 29S/30G/616T/648A, 29S/75S/263T/568P/570E/648A, 29S/168E/648A, 29S/263T/527L/568P, 75S, 75S/143Q/168E/527L, 75S/168E, 75S/616T, 143Q, 168E/247S/482V/648A, 168E/263T/616T, 168E/482V/616T, 168E/495L/616T, 263T, 263T/616T, 429P/545V, 495L, and 527T, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from N29S, N29S/R30G, N29S/R30G/E143Q/S263T/R482V/V646E, N29S/R30G/S263T, N29S/R30G/K616T/R648A, N29S/R75S/S263T/L568P/K570E/R648A, N29S/S168E/R648A, N29S/S263T/K527L/L568P, R75S, R75S/E143Q/S168E/K527L, R75S/S168E, R75S/K616T, E143Q, S168E/G247S/R482V/R648A, S168E/S263T/K616T, S168E/R482V/K616T, S168E/I495L/K616T, S263T, S263T/K616T, K429P/I545V, I495L, and K527T, wherein the amino acid positions of the polypeptide sequence are numbered with reference to SEQ ID NO: 1136 or 2106.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set at one or more positions selected from 207, 222, 266, 307, 454, 535, 546, 548, 580, 604, and 610, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from 207R, 222T, 266K, 307L, 454L, 535V, 546R, 548S, 580C, 604P, and 610R, wherein the amino acid positions of the polypeptide sequence are numbered with reference to SEQ ID NO: 1136 or 2106. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the recombinant protease comprises at least one substitution or substitution set selected from Q207R, S222T, A266K, Q307L, A454L, E535V, V546R, D548S, H580C, H604P, and A610R, wherein the amino acid positions of the polypeptide sequence are numbered with reference to SEQ ID NO: 1136 or 2106.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the recombinant protease comprises at least one substitution or substitution set at one or more positions selected from 75/168/207/454/568/586/610/648/659, 75/168/266/454/546/570/580, 75/207/454/570/659, 75/207/546/580/648, 75/263/454/548/568/604/648, 75/266/454, 75/454, 75/454/546/548/568/604, 75/546/548/610/648, 168/207/263/454/568/570/604, 168/263/266/546/604, 168/454/604, 207/604/610, 209, 212, 221, 223, 228, 266/454/568, 319, 373, 412/546/554, 431, 454, 454/546/568/570/580, 454/546/570, 454/570/580/610, 454/580, 454/659, and 506, wherein the amino acid positions of the polypeptide sequence are numbered with reference to SEQ ID NO: 1180 or 2150. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the recombinant protease comprises at least one substitution or substitution set selected from 75S/168E/207R/454L/568P/586V/610R/648A/659T, 75S/168E/266K/454L/546R/570E/580C, 75S/207R/454L/570E/659T, 75S/207R/546R/580C/648A, 75S/263T/454L/548S/568P/604P/648A, 75S/266K/454L, 75S/454L, 75S/454L/546R/548S/568P/604P, 75S/546R/548S/610R/648A, 168E/207R/263T/454L/568P/570E/604P, 168E/263T/266K/546R/604P, 168E/454L/604P, 207R/604P/61 OR, 209V, 212S, 221I, 223Q, 228I, 228V, 266K/454L/568P, 319Q, 373F, 412Y/546L/554M, 431T, 454I, 454L/546R/568P/570E/580C, 454L/546R/570E, 454L/570E/580C/610R, 454L/580C, 454L/659T, and 506N, wherein the amino acid positions of the polypeptide sequence are numbered with reference to SEQ ID NO: 1180 or 2150. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the recombinant protease comprises at least one substitution or substitution set selected from R75S/S168E/Q207R/A454L/L568P/L586V/A610R/R648A/E659T, R75S/S168E/A266K/A454L/V546R/K570E/H580C, R75S/Q207R/A454L/K570E/E659T, R75S/Q207R/V546R/H580C/R648A, R75S/S263T/A454L/D548S/L568P/H604P/R648A, R75S/A266K/A454L, R75S/A454L, R75S/A454L/V546R/D548S/L568P/H604P, R75S/V546R/D548S/A610R/R648A, S168E/Q207R/S263T/A454L/L568P/K570E/H604P, S168E/S263T/A266K/V546R/H604P, S168E/A454L/H604P, Q207R/H604P/A610R, I209V, D212S, L221I, N223Q, T228I, T228V, A266K/A454L/L568P, N319Q, L373F, F412Y/V546L/L554M, P431T, A454I, A454L/V546R/L568P/K570E/H580C, A454L/V546R/K570E, A454L/K570E/H580C/A610R, A454L/H580C, A454L/E659T, and G506N, wherein the amino acid positions of the polypeptide sequence are numbered with reference to SEQ ID NO: 1180 or 2150.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the recombinant protease comprises at least one substitution or substitution set at one or more positions selected from 75/189/373/582, 75/200/212/431/482, 75/212/373/431/482, 75/212/431/482/568/615/664, 75/368/582, 75/373/431/526/582, 75/431/482/570/604/664, 75/632, 189/212/431/568/570, 200/205/373/431, 200/431/482/615/664, 200/482/664, 212/228/431, 212/228/568/570/582/664, 212/373/446/482/582, 368/373/431, 373/431/570/604/664, 373/568/632, 431, 431/604/664, 482/582, 582, and 615/652/664, wherein the amino acid positions of the polypeptide sequence are numbered with reference to SEQ ID NO: 1250 or 2220. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the recombinant protease comprises at least one substitution or substitution set selected from 75S/189A/373F/582G, 75S/200W/212S/431T/482S, 75S/212S/373F/431T/482S, 75S/212S/431T/482S/568P/615M/664G, 75S/368M/582G, 75S/373F/431T/526E/582G, 75S/431T/482S/570K/604P/664G, 75S/632Q, 189A/212S/431T/568P/570K, 200W/205S/373F/431T, 200W/431T/482S/615M/664G, 200W/482S/664W, 212S/228V/431T, 212S/228V/568P/570K/582G/664W, 212S/373F/446F/482S/582G, 368M/373F/431T, 373F/431T/570K/604P/664W, 373F/568P/632Q, 431T, 431T/604P/664G, 482S/582G, 582G, and 615M/652V/664G, wherein the amino acid positions of the polypeptide sequence are numbered with reference to SEQ ID NO: 1250 or 2220. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the recombinant protease comprises at least one substitution or substitution set selected from R75S/K189A/L373F/R582G, R75S/K200W/D212S/P431T/R482S, R75S/D212S/L373F/P431T/R482S, R75S/D212S/P431T/R482S/L568P/K615M/R664G, R75S/K368M/R582G, R75S/L373F/P431T/R526E/R582G, R75S/P431T/R482S/E570K/H604P/R664G, R75S/K632Q, K189A/D212S/P431T/L568P/E570K, K200W/R205S/L373F/P431T, K200W/P431T/R482S/K615M/R664G, K200W/R482S/R664W, D212S/T228V/P431T, D212S/T228V/L568P/E570K/R582G/R664W, D212S/L373F/R446F/R482S/R582G, K368M/L373F/P431T, L373F/P431T/E570K/H604P/R664W, L373F/L568P/K632Q, P431T, P431T/H604P/R664G, R482S/R582G, R582G, and K615M/K652V/R664G, wherein the amino acid positions of the polypeptide sequence are numbered with reference to SEQ ID NO: 1250 or 2220.

In some additional embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308 or 2278, or a functional fragment thereof, and wherein the recombinant protease comprises at least one substitution or substitution set at one or more positions selected from 408/439, 439/514, 470, 470/667, 514, 514/537, and 537, wherein the amino acid positions of the polypeptide sequence are numbered with reference to SEQ ID NO: 1308 or 2278. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308 or 2278, or a functional fragment thereof, and wherein the recombinant protease comprises at least one substitution or substitution set selected from 408A/439S, 439S/514R, 470G, 470G/667D, 470P, 514R, 514R/537E, and 537E, wherein the amino acid positions of the polypeptide sequence are numbered with reference to SEQ ID NO: 1308 or 2278. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308 or 2278, or a functional fragment thereof, and wherein the recombinant protease comprises at least one substitution or substitution set selected from V408A/M439S, M439S/H514R, Q470G, Q470G/G667D, Q470P, H514R, H514R/P537E, and P537E, wherein the amino acid positions of the polypeptide sequence are numbered with reference to SEQ ID NO: 1308 or 2278.

In some additional embodiments, the recombinant protease comprises at least one mutation in at least one position as provided in Tables 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the positions are numbered with reference to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease comprises a polypeptide sequence having at least about 80%, at least about 85%, about 86%, about 87%, about 88%, about 89%, about 90%, about 91%, about 92%, about 93%, about 94%, about 95%, about 96%, about 97%, about 98%, about 99%, or more sequence identity to at least one sequence set forth in the even-numbered sequences of SEQ ID NOS: 4-1362 and 1366-2332. In some further embodiments, the recombinant protease comprises a polypeptide sequence having at least at least 80% 85%, 86%, 87%, 88%, 89%, 90%, 91%, 92%, 93%, 94%, 95%, 96%, 97%, 98%, 99%, or more sequence identity to at least one sequence set forth in the even-numbered sequences of SEQ ID NOS: 4-1362 and 1366-2332. In some further embodiments, the recombinant protease comprises a polypeptide sequence having at least 80%, 85%, 86%, 87%, 88%, 89%, 90%, 91%, 92%, 93%, 94%, 95%, 96%, 97%, 98%, 99%, or more sequence identity to a polypeptide sequence of SEQ ID NO: 34, 190, 292, 342, 382, 400, 454, 562, 638, 680, 756, 812, 1030, 1136, 1180, 1250, 1308, 1364, 1370, 1424, 1532, 1608, 1650, 1726, 1782, 2000, 2106, 2150, 2220, 2278, and 2332.

In some additional embodiments, the recombinant protease comprises at least one sequence set forth in the even-numbered sequences of SEQ ID NOS: 4-1362 and 1366-2332. In additional embodiments, the recombinant protease comprises at least one sequence set forth in the even-numbered sequences of SEQ ID NOS: 4-1362. In some embodiments, the recombinant protease comprises at least one sequence set forth in the even-numbered sequences of SEQ ID NOS: 1366-2332.

In some embodiments, the recombinant protease comprises at least one sequence set forth in the even-numbered sequences of SEQ ID NOS: 4-20. In some embodiments, the recombinant protease comprises at least one sequence set forth in the even-numbered sequences of SEQ ID NOS: 22-188. In some embodiments, the recombinant protease comprises at least one sequence set forth in the even-numbered sequences of SEQ ID NOS: 190-268. In some embodiments, the recombinant protease comprises at least one sequence set forth in the even-numbered sequences of SEQ ID NOS: 270-282. In some embodiments, the recombinant protease comprises at least one sequence set forth in the even-numbered sequences of SEQ ID NOS: 284-340. In some embodiments, the recombinant protease comprises at least one sequence set forth in the even-numbered sequences of SEQ ID NOS: 342-380. In some embodiments, the recombinant protease comprises at least one sequence set forth in the even-numbered sequences of SEQ ID NOS: 382-394. In some embodiments, the recombinant protease comprises at least one sequence set forth in the even-numbered sequences of SEQ ID NOS: 396-450 and 1366-1420. In some embodiments, the recombinant protease comprises at least one sequence set forth in the even-numbered sequences of SEQ ID NOS: 452-522 and 1422-1492. In some embodiments, the recombinant protease comprises at least one sequence set forth in the even-numbered sequences of SEQ ID NOS: 524-574 and 1494-1544. In some embodiments, the recombinant protease comprises at least one sequence set forth in the even-numbered sequences of SEQ ID NOS: 576-646 and 1546-1616. In some embodiments, the recombinant protease comprises at least one sequence set forth in the even-numbered sequences of SEQ ID NOS: 648-660 and 1618-1630. In some embodiments, the recombinant protease comprises at least one sequence set forth in the even-numbered sequences of SEQ ID NOS: 662-684 and 1632-1654. In some embodiments, the recombinant protease comprises at least one sequence set forth in the even-numbered sequences of SEQ ID NOS: 686-728 and 1656-1698. In some embodiments, the recombinant protease comprises at least one sequence set forth in the even-numbered sequences of SEQ ID NOS: 730-756 and 1700-1726. In some embodiments, the recombinant protease comprises at least one sequence set forth in the even-numbered sequences of SEQ ID NOS: 758-836 and 1728-1806. In some embodiments, the recombinant protease comprises at least one sequence set forth in the even-numbered sequences of SEQ ID NOS: 838-854 and 1808-1824. In some embodiments, the recombinant protease comprises at least one sequence set forth in the even-numbered sequences of SEQ ID NOS: 856-886 and 1826-1856. In some embodiments, the recombinant protease comprises at least one sequence set forth in the even-numbered sequences of SEQ ID NOS: 888-910 and 1858-1880. In some embodiments, the recombinant protease comprises at least one sequence set forth in the even-numbered sequences of SEQ ID NOS: 912-916 and 1882-1886. In some embodiments, the recombinant protease comprises at least one sequence set forth in the even-numbered sequences of SEQ ID NOS: 918-1058 and 1888-2028. In some embodiments, the recombinant protease comprises at least one sequence set forth in the even-numbered sequences of SEQ ID NOS: 1060-1172 and 2030-2142. In some embodiments, the recombinant protease comprises at least one sequence set forth in the even-numbered sequences of SEQ ID NOS: 1174-1216 and 2144-2186. In some embodiments, the recombinant protease comprises at least one sequence set forth in the even-numbered sequences of SEQ ID NOS: 1218-1238 and 2188-2208. In some embodiments, the recombinant protease comprises at least one sequence set forth in the even-numbered sequences of SEQ ID NOS: 1240-1300 and 2210-2270. In some embodiments, the recombinant protease comprises at least one sequence set forth in the even-numbered sequences of SEQ ID NOS: 1302-1346 and 2272-2316. In some embodiments, the recombinant protease comprises at least one sequence set forth in the even-numbered sequences of SEQ ID NOS: 1348-1362 and 2318-2332. In some embodiments, the recombinant protease comprises a polypeptide sequence selected from SEQ ID NO: 34, 190, 292, 342, 382, 400, 454, 562, 638, 680, 756, 812, 1030, 1136, 1180, 1250, 1308, 1364, 1370, 1424, 1532, 1608, 1650, 1726, 1782, 2000, 2106, 2150, 2220, 2278, and 2332.

In some embodiments, the engineered protease polypeptide comprises a functional fragment of an engineered protease polypeptide encompassed by the invention. Functional fragments have at least 80%, 81%, 82%, 83%, 84%, 85%, 86%, 87%, 88%, 89%, 90%, 91%, 92%, 93%, 94%, 95%, 96%, 97%, 98%, or 99% of the activity of the engineered protease polypeptide from which is was derived (i.e., the parent engineered protease or reference protease described herein). In some embodiments, a functional fragment comprises at least 80%, 81%, 82%, 83%, 84%, 85%, 86%, 87%, 88%, 89%, 90%, 91%, 92%, 93%, 94%, 95%, 96%, 97%, 98% and even 99% of the parent sequence of the engineered protease. In some embodiments the functional fragment is truncated by less than 5, less than 10, less than 15, less than 10, less than 25, less than 30, less than 35, less than 40, less than 45, and less than 50 amino acids.

The engineered proteases of the present invention comprise at least one improved property, when compared to a reference sequence. In some embodiments, the reference sequence is a wild-type protease, while in some other embodiments, the reference sequence is another engineered protease.

In some additional embodiments, the recombinant protease is more thermostable than the protease of SEQ ID NO: 2. In some further embodiments, the recombinant protease is more thermostable than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease is stable at 40 to 50° C. In some embodiments, the recombinant protease is stable at 25° C., 37° C., 42° C., and/or 48° C. In some additional embodiments, the recombinant protease is more stable than a reference sequence at 40 to 50° C. In some embodiments, the recombinant protease is more stable than a reference sequence at 25° C., 37° C., 42° C., and/or 48° C. In some additional embodiments, the recombinant protease is more thermostable than the protease of SEQ ID NO: 2. In some further embodiments, the recombinant protease is more thermostable than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease is stable in low pH environments, while in other embodiments, the recombinant protease is stable in high pH environments. In some embodiments, the recombinant protease is stable in both low and high pH environments. In some additional embodiments, the recombinant protease is more stable at either a high or low pH environment (or both environments), as compared to a reference sequence. In some embodiments, the reference sequence is wild-type protease, while in other embodiments, the reference sequence is another engineered protease. In some additional embodiments, the recombinant protease is more stable than the protease of SEQ ID NO: 2. In some further embodiments, the recombinant protease is more stable than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pHs greater than 7, than the protease of SEQ ID NO: 2. In some additional embodiments, the recombinant protease is more stable at pHs greater than 7, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 7.8, than the protease of SEQ ID NO: 2. In some additional embodiments, the recombinant protease is more stable at pH 7.8, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 7.5, than the protease of SEQ ID NO: 2. In some additional embodiments, the recombinant protease is more stable at pH 7.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 7, than the protease of SEQ ID NO: 2. In some additional embodiments, the recombinant protease is more stable at pH 7, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pHs less than 7, than the protease of SEQ ID NO: 2. In some additional embodiments, the recombinant protease is more stable at pHs less than pH 7, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 6.5, than the protease of SEQ ID NO: 2. In some additional embodiments, the recombinant protease is more stable at pH 6.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 6, than the protease of SEQ ID NO: 2. In some additional embodiments, the recombinant protease is more stable at pH 6, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pHs less than 5, than the protease of SEQ ID NO: 2. In some additional embodiments, the recombinant protease is more stable at pH 5, than the protease of SEQ ID NO: 2. In some additional embodiments, the recombinant protease is more stable at pH 5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 4, than the protease of SEQ ID NO: 2. In some further embodiments, the recombinant protease is more stable at pH 5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 3.8, than the protease of SEQ ID NO: 2. In some additional embodiments, the recombinant protease is more stable at pH 3.8, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 3.26, than the protease of SEQ ID NO: 2. In some additional embodiments, the recombinant protease is more stable at pH 3.26, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 3.5, than the protease of SEQ ID NO: 2. In some further embodiments, the recombinant protease is more stable at pH 3.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 3, than the protease of SEQ ID NO: 2. In some further embodiments, the recombinant protease is more stable at pH 3, than the protease of SEQ ID NO: 34, 190, 292, 342, 382, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the recombinant protease is more stable at pH 2.75, than the protease of SEQ ID NO: 2. In some additional embodiments, the recombinant protease is more stable at pH 2.75, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 2.5, than the protease of SEQ ID NO: 2. In some further embodiments, the recombinant protease is more stable at pH 2.5, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is more stable at pH 2, than the protease of SEQ ID NO: 2. In some further embodiments, the recombinant protease is more stable at pH 2, than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease is more resistant to proteolysis than the protease of SEQ ID NO: 2. In some embodiments, the recombinant protease is more resistant to proteolysis than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease is resistant to proteolysis by pepsin. In some additional embodiments, the recombinant protease is more resistant to proteolysis by pepsin than the protease of SEQ ID NO: 2. In some embodiments, the recombinant protease is more resistant to proteolysis by pepsin than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some embodiments, the recombinant protease of the present invention is resistant to autolysis. In some embodiments, the recombinant protease is more resistant to autolysis than the protease of SEQ ID NO: 2. In some embodiments, the recombinant protease is more resistant to autolysis than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278.

In some additional embodiments, the recombinant protease is active in the presence of at least one bile salt. In some additional embodiments, the recombinant protease is more active in the presence of at least one bile salt than the protease of SEQ ID NO: 2. In some additional embodiments, the recombinant protease is more active in the presence of at least one bile salt than the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some additional embodiments, the bile salt is taurocholate.

In yet some additional embodiments, the recombinant protease exhibits more than one improved property, as compared to wild-type protease or another recombinant protease. In some embodiments, the recombinant protease exhibits more than one improved property as compared to SEQ ID NO:2, while in some additional embodiments, the recombinant protease exhibits more than one improved property as compared to SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the improved properties are selected from acid stability, alkaline stability, stability at acidic pH, stability at alkaline pH, stability at neutral pH, thermostability, proteolysis resistance, autolysis resistance, and increased activity in the presence of at least one bile salt. In some embodiments, the improved properties are selected from activity at acidic pH, stability at acidic pH, stability at neutral pH, thermostability, proteolysis resistance, autolysis resistance, and increased activity in the presence of at least one bile salt. In yet some additional embodiments, the recombinant protease is more stable and/or active at acidic pHs, more thermostable, more resistant to proteolysis, more resistant to autolysis, and/or more active in the presence of at least one bile salt than the protease of SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. It is contemplated that any combination of improved properties will find use in the present invention. It is not intended that the present invention be limited to any specific combination of improved properties. Furthermore, in some embodiments, there are two improved properties, while in some other embodiments, there are three improved properties, in some additional embodiments, there are four improved properties, and in some additional embodiments, there are five or more improved properties. It is also contemplated that the recombinant protease of the present invention furthers comprise additional improvements. In some embodiments, these additional improvements provide advantages over wild-type protease, while in some other embodiments, the additional improvements will provide advantages over other recombinant proteases.

In some embodiments, the recombinant protease exhibits at least one improved property selected from improved stability and/or activity at acidic pHs, improved thermostability, improved resistance to proteolysis, improved resistance to autolysis, and/or improved activity in the presence of at least one bile salt, as compared to the protease of SEQ ID NO: 2. In some embodiments, the recombinant protease exhibits at least one improved property selected from improved stability and/or activity at acidic pHs, improved thermostability, improved resistance to proteolysis, improved resistance to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least two improved properties selected from improved stability and/or activity at acidic pHs, improved thermostability, improved resistance to proteolysis, improved resistance to autolysis, and/or improved activity in the presence of at least one bile salt, as compared to the protease of SEQ ID NO: 2. In some embodiments, the recombinant protease exhibits at least two improved properties selected from improved stability and/or activity at acidic pHs, improved thermostability, improved resistance to proteolysis, improved resistance to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least three improved properties selected from improved stability and/or activity at acidic pHs, improved thermostability, improved resistance to proteolysis, improved resistance to autolysis, and/or improved activity in the presence of at least one bile salt, as compared to the protease of SEQ ID NO: 2. In some embodiments, the recombinant protease exhibits at least three improved properties selected from improved stability and/or activity at acidic pHs, improved thermostability, improved resistance to proteolysis, improved resistance to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits the improved properties of improved stability and/or activity at acidic pHs, improved thermostability, improved resistance to proteolysis, improved resistance to autolysis, and improved activity in the presence of at least one bile salt, as compared to the protease of SEQ ID NO: 2. In some embodiments, the recombinant protease exhibits the improved properties of improved stability and/or activity at acidic pHs, improved thermostability, improved resistance to proteolysis, improved resistance to autolysis, and/or improved activity in the presence of at least one bile salt, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from improved stability and/or activity at acidic pHs, improved thermostability, improved resistance to proteolysis, improved resistance to autolysis, and/or improved activity in the presence of at least one bile salt, as well as at least one additional improved property, as compared to the protease of SEQ ID NO: 2. In some embodiments, the recombinant protease exhibits at least one improved property selected from improved stability and/or activity at acidic pHs, improved thermostability, improved resistance to proteolysis, improved resistance to autolysis, and/or improved activity in the presence of at least one bile salt, as well as at least one additional improved property, as compared to the protease of SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermo tolerance; viii) increased tolerance to autolysis, or a combination of any of i), ii), iii), iv), v), vi), vii), and viii), as compared to a reference sequence. In some embodiments, the reference sequence is SEQ ID NO: 2, while in some alternative embodiments, the reference sequence is selected from SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermotolerance; viii) increased tolerance to autolysis; or a combination of any of i), ii), iii), iv), v), vi), vii), and viii), as compared to at least one reference sequence. In some embodiments, the reference sequence is SEQ ID NO: 2, while in some alternative embodiments, the reference sequence is selected from SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some embodiments, the recombinant protease exhibits at least one improved property selected from: i) enhanced catalytic activity; ii) increased tolerance to acid pH; iii) increased tolerance to pH 3.5; iv) increased tolerance to pH 3; v) increased tolerance to at least one protease; vi) increased tolerance to at least one bile salt; vii) increased thermotolerance; viii) increased tolerance to autolysis; or a combination of any of i), ii), iii), iv), v), vi), vii), and viii), as compared to at least two or more reference sequences. In some embodiments, the reference sequence is selected from SEQ ID NO: 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278. In some further embodiments, the recombinant protease is purified.

In still some further embodiments, the protease is stable in food and/or beverages. In some additional embodiments, the protease is stable in nutritional and other supplements. In some embodiments, the supplements are liquid, while in other embodiments, they are emulsions, suspensions, or solids. It is not intended that the present invention be limited to any particular food, beverage, and/or supplement format or form.

Polynucleotides Encoding Engineered Polypeptides, Expression Vectors, and Host Cells:

The present invention provides polynucleotides encoding the engineered protease polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered protease polypeptides can be introduced into appropriate host cells to express the corresponding protease polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered protease polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Tables 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, or in Tables 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the variant lacks the histidine tag and the preceding amino acid linker.

In various embodiments, the codons are preferably selected to fit the host cell in which the protein is being produced. For example, preferred codons used in bacteria are used for expression in bacteria, while preferred codons used in fungi are used for expression in fungi. Consequently, codon optimized polynucleotides encoding the engineered protease polypeptides contain preferred codons at about 40%, 50%, 60%, 70%, 80%, or greater than 90% of codon positions of the full length coding region.

In some embodiments, the present invention provides a recombinant polynucleotide sequence having at least about 80%, at least about 85%, about 86%, about 87%, about 88%, about 89%, about 90%, about 91%, about 92%, about 93%, about 94%, about 95%, about 96%, about 97%, about 98%, about 99%, or more sequence identity to SEQ ID NO: 1, 33, 189, 2, 291, 341, 381, 395, 399, 453, 561, 637, 679, 755, 811, 1029, 1135, 1179, 1249, 1307, 1365, 1369, 1423, 1531, 1607, 1649, 1725, 1781, 1999, 2105, 2149, 2219, and/or 2277. In some embodiments, the present invention provides a recombinant polynucleotide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1, 33, 189, 2, 291, 341, 381, 395, 399, 453, 561, 637, 679, 755, 811, 1029, 1135, 1179, 1249, 1307, 1365, 1369, 1423, 1531, 1607, 1649, 1725, 1781, 1999, 2105, 2149, 2219, and/or 2277. In some embodiments, the recombinant polynucleotide sequence has at least 80%, 85%, 86%, 87%, 88%, 89%, 90%, 91%, 92%, 93%, 94%, 95%, 96%, 97%, 98%, 99% or more sequence identity to the odd-numbered sequences of SEQ ID NOS: 3-1361 and 1365-2331. In some embodiments, the polynucleotide encoding the engineered protease polypeptides comprises the polynucleotide sequence of SEQ ID NO: 1, 33, 189, 2, 291, 341, 381, 395, 399, 453, 561, 637, 679, 755, 811, 1029, 1135, 1179, 1249, 1307, 1365, 1369, 1423, 1531, 1607, 1649, 1725, 1781, 1999, 2105, 2149, 2219, and/or 2277.

In some embodiments, as described herein, the polynucleotide encodes an engineered polypeptide having protease activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more identity to a reference sequence (e.g., SEQ ID NO: 2, 34, 190, 292, 342, 382, 396, 400, 454, 562, 638, 680, 756, 812, 1030, 1136, 1180, 1250, 1308, 1136, 1180, 1250, 1308, 1366, 1370, 1424, 1532, 1608, 1650, 1726, 1782, 2000, 2106, 2150, 2220, and/or 2278), or the amino acid sequence of any variant as disclosed in Tables 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, or any variant disclosed in Tables 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the variant lacks the histidine tag and preceding amino acid linker, and one or more residue differences as compared to the reference polypeptide of SEQ ID NO: 2, 34, 190, 292, 342, 382, 396, 400, 454, 562, 638, 680, 756, 812, 1030, 1136, 1180, 1250, 1308, 1136, 1180, 1250, 1308, 1366, 1370, 1424, 1532, 1608, 1650, 1726, 1782, 2000, 2106, 2150, 2220, and/or 2278, or the amino acid sequence of any variant as disclosed in the Tables (for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acid residue positions). In some embodiments, the polynucleotide encodes an engineered polypeptide having protease activity with the properties disclosed herein, wherein the polypeptide comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence SEQ ID NO: 2, 34, 190, 292, 342, 382, 396, 400, 454, 562, 638, 680, 756, 812, 1030, 1136, 1180, 1250, 1308, 1136, 1180, 1250, 1308, 1366, 1370, 1424, 1532, 1608, 1650, 1726, 1782, 2000, 2106, 2150, 2220, and/or 2278, and one or more residue differences as compared to SEQ ID NO: 2, 34, 190, 292, 342, 382, 396, 400, 454, 562, 638, 680, 756, 812, 1030, 1136, 1180, 1250, 1308, 1136, 1180, 1250, 1308, 1366, 1370, 1424, 1532, 1608, 1650, 1726, 1782, 2000, 2106, 2150, 2220, and/or 2278, at residue positions selected from those provided in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, when optimally aligned with the polypeptide of SEQ ID NO: 2, 34, 190, 292, 342, 382, 396, 400, 454, 562, 638, 680, 756, 812, 1030, 1136, 1180, 1250, 1308, 1136, 1180, 1250, 1308, 1366, 1370, 1424, 1532, 1608, 1650, 1726, 1782, 2000, 2106, 2150, 2220, and/or 2278.

In some embodiments, the polynucleotide encodes a recombinant protease comprising a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the recombinant protease comprises at least one substitution or substitution set at one or more positions selected from 236, 258, 261, 339, 439, 446, and 454, wherein the amino acid positions of the polypeptide sequence are numbered with reference to SEQ ID NO: 2. In some embodiments, the recombinant protease comprises at least one substitution or substitution set selected from 236V, 258K, 261L, 339M, 339W, 439M, 446A, 446G, 446L, 446M, 446T, and 454L, wherein the amino acid positions of the polypeptide sequence are numbered with reference to SEQ ID NO: 2. In some embodiments, the recombinant protease comprises at least one substitution or substitution set selected from M236V, Q258K, E261L, N339M, N339W, S439M, P446A, P446G, P446L, P446M, P446T, and A454L, wherein the amino acid positions of the polypeptide sequence are numbered with reference to SEQ ID NO: 2.

In some embodiments, the polynucleotide encodes a recombinant protease comprising a polypeptide sequence having at least 70%, 75%, 80%, 85%, 86%, 87%, 88%, 89%, 90%, 91%, 92%, 93%, 94%, 95%, 96%, 97%, 98%, 99%, or more sequence identity to SEQ ID NO: 2, or a functional fragment thereof, and wherein the encoded recombinant protease comprises at least one substitution or substitution set at one or more positions selected from 107/536, 162/408, 168/547, 208/366/504/591, 208/485/526, 210/223/258/552, 210/241/258/599, 223/241/258/599, 223/429/481/533, 223/481/533/552, 225, 225/260/263/265/544, 225/262, 225/362/366/591, 225/366, 225/482/591, 244, 258, 258/318/429, 258/449/481, 258/481, 261, 261/504, 318/481, 318/533, 318/599, 339, 342, 345, 362/366/485/591, 363, 366, 366/485, 366/497, 366/526/591, 366/591, 408, 427, 446, 448, 449, 450, 481/533/552, 482, 482/485, 482/591, 485, 485/591, 533, 533/552, 536, 544, 547, 549, 565, 615, and 652, wherein the amino acid positions of the polypeptide sequence are numbered with reference to SEQ ID NO: 2. In some embodiments, the encoded recombinant protease comprises at least one substitution or substitution set selected from 107T/536D, 162I/408R, 168N/547V, 208T/366G/504P/591L, 208T/485D/526L, 210D/223R/258K/552N, 210D/241P/258K/599L, 223R/241P/258K/599L, 223R/429L/481S/533K, 223R/481S/533K/552N, 225A/260D/263H/265R/544R, 225A/262L, 225A/362T/366G/591L, 225A/366G, 225A/482V/591L, 225K, 244K, 258K, 258K/318D/429L, 258K/449V/481S, 258K/481S, 258R, 261G, 261G/504V, 261L, 261R, 261S, 261V, 318D/481S, 318D/533K, 318D/599L, 339F, 339W, 342R, 345W, 362T/366G/485D/591L, 363E, 363W, 366A, 366G, 366G/485D, 366G/497R, 366G/526L/591L, 366G/591L, 366L, 366Q, 408R, 427H, 427R, 446R, 446V, 448K, 448R, 448W, 449K, 450W, 481S/533K/552N, 482V, 482V/485D, 482V/591L, 485D, 485D/591L, 533A, 533D, 533E, 533K, 533K/552N, 533N, 536E, 536G, 536V, 544R, 547A, 547E, 549T, 565C, 565D, 615A, 615D, 615G, 615P, 615T, 615W, and 652I, wherein the amino acid positions of the polypeptide sequence are numbered with reference to SEQ ID NO: 2. In some embodiments, the encoded recombinant protease comprises at least one substitution or substitution set selected from M107T/Q536D, T162I/A408R, S168N/Q547V, A208T/N366G/Q504P/K591L, A208T/N485D/R526L, N210D/N223R/Q258K/K552N, N210D/E241P/Q258K/D599L, N223R/E241P/Q258K/D599L, N223R/K429L/A481S/M533K, N223R/A481S/M533K/K552N, T225A/N260D/R263H/G265R/T544R, T225A/P262L, T225A/N362T/N366G/K591L, T225A/N366G, T225A/R482V/K591L, T225K, R244K, Q258K, Q258K/Q318D/K429L, Q258K/A449V/A481S, Q258K/A481S, Q258R, E261G, E261G/Q504V, E261L, E261R, E261S, E261V, Q318D/A481S, Q318D/M533K, Q318D/D599L, N339F, N339W, L342R, Q345W, N362T/N366G/N485D/K591L, Q363E, Q363W, N366A, N366G, N366G/N485D, N366G/Q497R, N366G/R526L/K591L, N366G/K591L, N366L, N366Q, A408R, P427H, P427R, P446R, P446V, N448K, N448R, N448W, A449K, N450W, A481S/M533K/K552N, R482V, R482V/N485D, R482V/K591L, N485D, N485D/K591L, M533A, M533D, M533E, M533K, M533K/K552N, M533N, Q536E, Q536G, Q536V, T544R, Q547A, Q547E, V549T, N565C, N565D, K615A, K615D, K615G, K615P, K615T, K615W, and K652I, wherein the amino acid positions of the polypeptide sequence are numbered with reference to SEQ ID NO: 2.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, or a functional fragment thereof, and wherein the encoded recombinant protease comprises at least one substitution or substitution set at one or more positions selected from 258, 258/261/342/345, 258/261/342/504/533, 258/261/345/504/549, 258/261/482/504/549, 258/342, 258/342/504/533/536/549, 258/345/427, 258/408/427/504/549, 258/427, 258/427/482/504/533/536, 258/427/482/536, 261/342/345/536, 261/342/482/504/533/536, 261/342/482/504/549, 261/342/482/536, 261/342/533, 261/482, 318/339/362/544/547, 318/339/448/544, 318/339/547, 318/448/544/615, 339/362/363/544/547/615, 339/362/544, 339/448, 339/448/547, 339/544/547, 342, 342/408, 342/408/536, 342/482/536, 362/363/544/547, 362/448, 363/544/547, 427/482/504/533/536, 427/533/536/549, 448, 448/544, and 448/544/547/615, wherein the amino acid positions of the polypeptide sequence are numbered with reference to SEQ ID NO: 34. In some embodiments, the encoded recombinant protease comprises at least one substitution or substitution set selected from 258K, 258K/261L/342R/345W, 258K/261L/342R/504P/533D, 258K/261L/345W/504P/549T, 258K/261R/482V/504P/549T, 258K/342R, 258K/342R/504P/533K/536E/549T, 258K/345W/427R, 258K/408R/427R/504P/549T, 258K/427R, 258K/427R/482V/504P/533K/536E, 258K/427R/482V/536E, 261L/342R/345W/536E, 261L/342R/482V/504P/533K/536E, 261L/342R/533D, 261R/342R/482V/504P/549T, 261R/342R/482V/536E, 261R/482V, 318D/339W/362T/544R/547E, 318D/339W/448R/544R, 318D/339W/547E, 318D/448R/544R/615A, 339W/362T/363E/544R/547E/615A, 339W/362T/544R, 339W/448K, 339W/448R, 339W/448R/547E, 339W/544R/547E, 342R, 342R/408R, 342R/408R/536E, 342R/482V/536E, 362T/363E/544R/547E, 362T/448R, 363E/544R/547E, 427R/482V/504P/533D/536E, 427R/533K/536E/549T, 448R, 448R/544R, and 448R/544R/547E/615A, wherein the amino acid positions of the polypeptide sequence are numbered with reference to SEQ ID NO: 34. In some embodiments, the encoded recombinant protease comprises at least one substitution or substitution set selected from Q258K, Q258K/E261L/L342R/Q345W, Q258K/E261L/L342R/Q504P/M533D, Q258K/E261L/Q345W/Q504P/V549T, Q258K/E261R/R482V/Q504P/V549T, Q258K/L342R, Q258K/L342R/Q504P/M533K/Q536E/V549T, Q258K/Q345W/P427R, Q258K/A408R/P427R/Q504P/V549T, Q258K/P427R, Q258K/P427R/R482V/Q504P/M533K/Q536E, Q258K/P427R/R482V/Q536E, E261L/L342R/Q345W/Q536E, E261L/L342R/R482V/Q504P/M533K/Q536E, E261L/L342R/M533D, E261R/L342R/R482V/Q504P/V549T, E261R/L342R/R482V/Q536E, E261R/R482V, Q318D/N339W/N362T/T544R/Q547E, Q318D/N339W/N448R/T544R, Q318D/N339W/Q547E, Q318D/N448R/T544R/K615A, N339W/N362T/Q363E/T544R/Q547E/K615A, N339W/N362T/T544R, N339W/N448K, N339W/N448R, N339W/N448R/Q547E, N339W/T544R/Q547E, L342R, L342R/A408R, L342R/A408R/Q536E, L342R/R482V/Q536E, N362T/Q363E/T544R/Q547E, N362T/N448R, Q363E/T544R/Q547E, P427R/R482V/Q504P/M533D/Q536E, P427R/M533K/Q536E/V549T, N448R, N448R/T544R, and N448R/T544R/Q547E/K615A, wherein the amino acid positions of the polypeptide sequence are numbered with reference to SEQ ID NO: 34.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 190, or a functional fragment thereof, and wherein the encoded recombinant protease comprises at least one substitution or substitution set at one or more positions selected from 205, 505, 541, 556, and 646, wherein the amino acid positions of the polypeptide sequence are numbered with reference to SEQ ID NO: 190. In some embodiments, the encoded recombinant protease comprises at least one substitution or substitution set selected from 205Q, 205T, 505A, 541R, 556V, 646L, and 646V, wherein the amino acid positions of the polypeptide sequence are numbered with reference to SEQ ID NO: 190. In some embodiments, the encoded recombinant protease comprises at least one substitution or substitution set selected from S205Q, S205T, Q505A, S541R, T556V, A646L, and A646V, wherein the amino acid positions of the polypeptide sequence are numbered with reference to SEQ ID NO: 190.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 292, or a functional fragment thereof, and wherein the encoded recombinant protease comprises at least one substitution or substitution set at one or more positions selected from 205/442/505/536/545/620/646, 205/505/536/541/545/547/558/646/665, 258, 263, 355/536/545/547, 359, 366, 446, 449, 505/536/545/558/646, 506, 555, 556, 620, and 650, wherein the amino acid positions of the polypeptide sequence are numbered with reference to SEQ ID NO: 292. In some embodiments, the encoded recombinant protease comprises at least one substitution or substitution set selected from 205R/442L/505A/536W/545E620V/646V, 205R/505A/536W/541E545R/547E/558E/646V/665E, 258G, 263M, 263S, 355R/536W/545I/547E, 359Y, 366S, 446P, 449L, 505A/536W/545I/558E/646V, 506R, 555D, 555G, 555L, 556G, 620L, 620Q, 620S, and 650T, wherein the amino acid positions of the polypeptide sequence are numbered with reference to SEQ ID NO: 292. In some embodiments, the encoded recombinant protease comprises at least one substitution or substitution set selected from S205R/V442L/Q505A/Q536W/A545I/E620V/A646V, S205R/Q505A/Q536W/S541I/A545R/Q547E/T558E/A646V/P665E, K258G, R263M, R263S, L355R/Q536W/A545I/Q547E, F359Y, N366S, R446P, A449L, Q505A/Q536W/A545I/T558E/A646V, G506R, E555D, E555G, E555L, T556G, E620L, E620Q, E620S, and I650T, wherein the amino acid positions of the polypeptide sequence are numbered with reference to SEQ ID NO: 292.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 342, or a functional fragment thereof, and wherein the encoded recombinant protease comprises at least one substitution or substitution set at one or more positions selected from 283/319/359/449/450/506, 283/345/359/449/450/553/555, 283/449/450/508/541/553/555, 449/450, 450/508/553/555/558, 508, and 508/541/553, wherein the amino acid positions of the polypeptide sequence are numbered with reference to SEQ ID NO: 342. In some embodiments, the encoded recombinant protease comprises at least one substitution or substitution set selected from 283H/345C/359Y/449L/450R/553T/555G, 283L/319K/359Y/449L/450R/506R, 283L/449L/450R/508G/54H/553T/555G, 449L/450R, 450R/508G/553R/555G/558E, 508G, and 508G/541I/553T, wherein the amino acid positions of the polypeptide sequence are numbered with reference to SEQ ID NO: 342. In some embodiments, the encoded recombinant protease comprises at least one substitution or substitution set selected from N283H/Q345C/F359Y/A449L/N450R/D553T/E555G, N283L/N319K/F359Y/A449L/N450R/G506R, N283L/A449L/N450R/N508G/S541I/D553T/E555G, A449L/N450R, N450R/N508G/D553R/E555G/T558E, N508G, and N508G/S541I/D553T, wherein the amino acid positions of the polypeptide sequence are numbered with reference to SEQ ID NO: 342.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 396 or 1366, or a functional fragment thereof, and wherein the encoded recombinant protease comprises at least one substitution or substitution set at one or more positions selected from 205, 205/442/449/450, 205/450/536/545, 205/450/536/545/646, 258/442/446, 258/442/449/646, 258/450/536/545, 308, 361, 439, 442/446/536/545/620/646, 442/450/536/545, 514, 535, 577, 591, 592, 610, 639, 643, and 644, wherein the amino acid positions of the polypeptide sequence are numbered with reference to SEQ ID NO: 396 or 1366. In some embodiments, the encoded recombinant protease comprises at least one substitution or substitution set selected from 205S, 205S/442V/449A/450N, 205S/450N/536Q/545A, 205S/450N/536Q/545A/646A, 258Q/442V/446P, 258Q/442V/449A/646A, 258Q/450N/536Q/545A, 308E, 361V, 439M, 442V/446P/536Q/545A/620E/646A, 442V/450N/536Q/545A, 514H, 535R, 535V, 577V, 591R, 591V, 592P, 610L, 610P, 610S, 639E, 639K, 643E, 643R, and 644A, wherein the amino acid positions of the polypeptide sequence are numbered with reference to SEQ ID NO: 396 or 1366. In some embodiments, the encoded recombinant protease comprises at least one substitution or substitution set selected from R205S, R205S/L442V/L449A/R450N, R205S/R450N/W536Q/I545A, R205S/R450N/W536Q/I545A/V646A, K258Q/L442V/R446P, K258Q/L442V/L449A/V646A, K258Q/R450N/W536Q/I545A, A308E, I361V, S439M, L442V/R446P/W536Q/I545A/V620E/V646A, L442V/R450N/W536Q/I545A, R514H, E535R, E535V, D577V, K591R, K591V, A592P, A610L, A610P, A610S, A639E, A639K, A643E, A643R, and D644A, wherein the amino acid positions of the polypeptide sequence are numbered with reference to SEQ ID NO: 396 or 1366.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 400 or 1370, or a functional fragment thereof, and wherein the encoded recombinant protease comprises at least one substitution or substitution set at one or more positions selected from 32/490/639, 236, 236/238/404/480/555/568/592, 236/359/404/406/555/639, 236/359/490/581/639, 236/359/555, 236/359/609, 236/370/406/568/581, 236/370/568/592, 236/370/581, 236/404/406/480/490, 236/404/555/581/609/639, 236/568, 236/592, 236/639, 238/359/370/404/490/568/639, 245/363/408/512/514/596/666, 245/363/512/514/537/560, 308/514/535/639/644, 359/404, 359/404/406/490/546/581, 363/408/512/514/537, 363/408/601/650, 363/639/644, 408/512/408/514/537, 408/514/560/650, 490/568/592/639, 512/537/560/601, 514/535/546/575/644, 514/639/644, 514/644, 535/575/639/644, 535/639/643/644, 535/643/644, and 601/650, wherein the amino acid positions of the polypeptide sequence are numbered with reference to SEQ ID NO: 400 or 1370. In some embodiments, the encoded recombinant protease comprises at least one substitution or substitution set selected from 32T/490E/639T, 236V, 236V/238E404G/480L/555Q/568P/592P, 236V/359Y/404G/406R/555Q/

639T, 236V/359Y/490E/581T/639T, 236V/359Y/555Q, 236V/359Y/609G, 236V/370C/406R/568P/581T, 236V/370C/568P/592P, 236V/370C/581T, 236V/404G/406R/480L/490E, 236V/404G/555Q/581T/609G/639T, 236V/568P, 236V/592P, 236V/639T, 238E359Y/370C/404G/490E/568P/639T, 245S/363K/408V/512N/514H/596T/666D, 245S/363K/512N/514H/537P/560S, 308E/514H/535R/639K/644A, 359Y/404G, 359Y/404G/406R/490E/546E/581T, 363H/639K/644A, 363K/408V/512N/514H/537P, 363K/408V/601E650T, 408V/512N, 408V/514H/537P, 408V/514H/560S/650T, 490E/568P/592P/639T, 512N/537P/560S/601I, 514H/535R/546E/575G/644A, 514H/639K/644A, 514H/644A, 535R/575G/639K/644A, 535R/639K/643R/644A, 535V/643R/644A, and 601I/650T, wherein the amino acid positions of the polypeptide sequence are numbered with reference to SEQ ID NO: 400 or 1370. In some embodiments, the encoded recombinant protease comprises at least one substitution or substitution set selected from I32T/Q490E/A639T, M236V, M236V/L238I/S404G/I480L/E555Q/L568I7A592P, M236V/F359Y/S404G/K406R/E555Q/A639T, M236V/F359Y/Q490E/S581T/A639T, M236V/F359Y/E555Q, M236V/F359Y/A609G, M236V/S370C/K406R/L568P/S581T, M236V/S370C/L568P/A592P, M236V/S370C/S581T, M236V/S404G/K406R/I480L/Q490E, M236V/S404G/E555Q/S581T/A609G/A639T, M236V/L568P, M236V/A592P, M236V/A639T, L238I/F359Y/S370C/S404G/Q490E/L568P/A639T, T245S/Q363K/A408V/S512N/R514H/M596T/S666D, T245S/Q363K/S512N/R514H/E537P/T560S, A308E/R514H/E535R/A639K/D644A, F359Y/S404G, F359Y/S404G/K406R/Q490E/V546E/S581T, Q363H/A639K/D644A, Q363K/A408V/S512N/R514H/E537P, Q363K/A408V/M601I/I650T, A408V/S512N, A408V/R514H/E537P, A408V/R514H/T560S/I650T, Q490E/L568P/A592P/A639T, S512N/E537P/T560S/M601I, R514H/E535R/V546E/S575G/D644A, R514H/A639K/D644A, R514H/D644A, E535R/S575G/A639K/D644A, E535R/A639K/A643R/D644A, E535V/A643R/D644A, and M601I/I650T, wherein the amino acid positions of the polypeptide sequence are numbered with reference to SEQ ID NO: 400 or 1370.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 454 or 1424, or a functional fragment thereof, and wherein the encoded recombinant protease comprises at least one substitution or substitution set at one or more positions selected from 236, 236/308/370/548, 236/308/490/581/643, 236/308/555/560/596, 236/370, 236/370/490/639, 236/555, 236/560/581, 245/359/363/406/535/650, 245/363/406/575/601/666, 300, 301, 308, 308/490/560/581/639/643, 336, 359/363/406/535/601/650, 359/404/406/535, 359/406/575/650/666, 359/535/575/601, 363/404/406/535/568, 404/406/535, 406, 406/480/535/568/601, 406/535/575, 468, and 480/575/601/650, wherein the amino acid positions of the polypeptide sequence are numbered with reference to SEQ ID NO: 454 or 1424. In some embodiments, the encoded recombinant protease comprises at least one substitution or substitution set selected from 236V, 236V/308E/370C/548E, 236V/308E/490E/581T/643R, 236V/308E/555Q/560S/596T, 236V/370C, 236V/370C/490E/639T, 236V/555Q, 236V/560S/581T, 245S/359Y/363K/406R/535R/650T, 245S/363K/406R/575G/601E666D, 300F, 301V, 308E, 308E/490E/560S/581T/639T/643R, 336W, 359Y/363K/406R/535R/601E650T, 359Y/404G/406R/535R, 359Y/406R/575G/650T/666D, 359Y/535R/575G/601I, 363K/404G/406R/535R/568P, 404G/406R/535R, 406R, 406R/480L/535R/568P/601I, 406R/535R/575G, 468S, and 480L/575G/601I/650T, wherein the amino acid positions of the polypeptide sequence are numbered with reference to SEQ ID NO: 454 or 1424. In some embodiments, the encoded recombinant protease comprises at least one substitution or substitution set selected from M236V, M236V/A308E/S370C/D548E, M236V/A308E/Q490E/S581T/A643R, M236V/A308E/E555Q/T560S/M596T, M236V/S370C, M236V/S370C/Q490E/A639T, M236V/E555Q, M236V/T560S/S581T, T245S/F359Y/Q363K/K406R/E535R/I650T, T245S/Q363K/K406R/S575G/M601I/S666D, L300F, A301V, A308E, A308E/Q490E/T560S/S581T/A639T/A643R, Y336W, F359Y/Q363K/K406R/E535R/M601I/I650T, F359Y/S404G/K406R/E535R, F359Y/K406R/S575G/I650T/S666D, F359Y/E535R/S575G/M601I, Q363K/S404G/K406R/E535R/L568P, S404G/K406R/E535R, K406R, K406R/I480L/E535R/L568P/M601I, K406R/E535R/S575G, A468S, and I480L/S575G/M601I/I650T, wherein the amino acid positions of the polypeptide sequence are numbered with reference to SEQ ID NO: 454 or 1424.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the encoded recombinant protease comprises at least one substitution or substitution set at one or more positions selected from 133/301/346/347/468, 205/236/347, 205/236/370/490/537/620, 205/342/439/442/514/620/639, 205/370/537, 205/442/505/620, 236/258/370/505/545/639, 236/339/514, 236/370/450/620, 236/545, 258/339/342/505/537, 258/342/370/408/442/537, 300/301/308/346/347/468, 300/301/347/468, 301/308/336/346/406/468/601, 301/308/346/406/468, 301/308/468/601, 301/347/406, 308/336/347/468, 308/347/468, 342, 342/408/490/505/514/545/639/646, 342/620, 370/442, 370/537/639, 489, 539/649, 542, 543, 543/673, 558, 559, 566, 634, and 661, wherein the amino acid positions of the polypeptide sequence are numbered with reference to SEQ ID NO: 562 or 1532. In some embodiments, the encoded recombinant protease comprises at least one substitution or substitution set selected from 133M/301V/346K/347F/468S, 205S/236M/347F, 205S/236M/370S/490Q/537E/620E, 205S/342L/439S/442V/514R/620E/639A, 205S/370S/537E, 205S/442V/505Q/620E, 236M/258Q/370S/505Q/545A/639A, 236M/339N/514R, 236M/370S/450N/620E, 236M/545A, 258Q/339N/342L/505Q/537E, 258Q/342L/370S/408A/442V/537E, 300F/301V/308E/346K/347F/468S, 300F/301V/347F/468S, 301V/308E/336W/346K/406R/468S/601I, 301V/308E/346K/406R/468S, 301V/308E/468S/601I, 301V/347F/406R, 308E/336W/347F/468S, 308E/347F/468S, 342L, 342L/408A/490Q/505Q/514R/545A/639A/646A, 342L/620E, 370S/442V, 370S/537E/639A, 489Y, 539M/649H, 542M, 543A, 543V/673Y, 558R, 559H, 559S, 566G, 634C, and 661D, wherein the amino acid positions of the polypeptide sequence are numbered with reference to SEQ ID NO: 562 or 1532. In some embodiments, the encoded recombinant protease comprises at least one substitution or substitution set selected from L133M/A301V/V346K/V347F/A468S, R205S/V236M/V347F, R205S/V236M/C370S/E490Q/P537E/V620E, R205S/R342L/M439S/L442V/H514R/V620E/T639A, R205S/C370S/P537E, R205S/L442V/A505Q/V620E, V236M/K258Q/C370S/A505Q/I545A/T639A, V236M/W339N/H514R, V236M/C370S/R450N/V620E, V236M/I545A, K258Q/W339N/R342L/A505Q/P537E, K258Q/R342L/C370S/V408A/L442V/P537E, L300F/ A301V/A308E/V346K/V347F/A468S, L300F/A301V/ V347F/A468S, A301V/A308E/Y336W/V346K/K406R/ A468S/M601I, A301V/A308E/V346K/K406R/A468S, A301V/A308E/A468S/M601I, A301V/V347F/K406R, A308E/Y336W/V347F/A468S, A308E/V347F/A468S, R342L, R342L/V408A/E490Q/A505Q/H514R/I545A/ T639A/V646A, R342L/V620E, C370S/L442V, C370S/ P537E/T639A, D489Y, P539M/D649H, I542M, F543A, F543V/H673Y, T558M, L559H, L559S, T566G, P634C, and G661D, wherein the amino acid positions of the polypeptide sequence are numbered with reference to SEQ ID NO: 562 or 1532.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 562 or 1532, or a functional fragment thereof, and wherein the encoded recombinant protease comprises at least one substitution or substitution set at one or more positions selected from 205/236/342/439/505/514/537/545, 236/342/505/514/537/ 545, 300/301/308/336/347/468/601, 300/301/347/406, 301/ 308/346/347/468, 301/336/346/347/406/601, and 308/336/ 347/406/468/601, wherein the amino acid positions of the polypeptide sequence are numbered with reference to SEQ ID NO: 562 or 1532. In some embodiments, the encoded recombinant protease comprises at least one substitution or substitution set selected from 205S/236M/342L/439S/505Q/ 514R/537E/545A, 236M/342L/505Q/514R/537E/545A, 300F/301V/308E/336W/347F/468S/601I, 300F/301V/ 347F/406R, 301V/308E/346K/347F/468S, 301V/336W/ 346K/347F/406R/601I, and 308E/336W/347F/406R/468S/ 601I, wherein the amino acid positions of the polypeptide sequence are numbered with reference to SEQ ID NO: 562 or 1532. In some embodiments, the encoded recombinant protease comprises at least one substitution or substitution set selected from R205S/V236M/R342L/M439S/A505Q/ H514R/P537E/I545A, V236M/R342L/A505Q/H514R/ P537E/I545A, L300F/A301V/A308E/Y336W/V347F/ A468S/M601I, L300F/A301V/V347F/K406R, A301V/ A308E/V346K/V347F/A468S, A301V/Y336W/V346K/ V347F/K406R/M601I, and A308E/Y336W/V347F/K406R/ A468S/M601I, wherein the amino acid positions of the polypeptide sequence are numbered with reference to SEQ ID NO: 562 or 1532.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1532, or a functional fragment thereof, and wherein the encoded recombinant protease comprises at least one substitution or substitution set at one or more positions selected from 346/511/537, 346/511/537/541/543, 346/511/542/582, 346/ 511/581/582, 346/511/583, 346/529/571/581/582/583/589, 511/537, 516/539/568, 537/582, 539, 568/662/663, and 581/ 582, wherein the amino acid positions of the polypeptide sequence are numbered with reference to SEQ ID NO: 638 or 1532. In some embodiments, the encoded recombinant protease comprises at least one substitution or substitution set selected from 346V/511S/537E, 346V/511S/537E/ 541E543G, 346V/511S/542S/582R, 346V/511S/581L/ 582R, 346V/511S/583R, 346V/529G/571I/581C/582V/ 583V/589A, 511S/537E, 516M/539E/568R, 537E/582R, 539E, 568R/662W/663W, and 581L/582R, wherein the amino acid positions of the polypeptide sequence are numbered with reference to SEQ ID NO: 638 or 1532. In some embodiments, the encoded recombinant protease comprises at least one substitution or substitution set selected from K346V/A511S/P537E, K346V/A511S/P537E/S541I/ F543G, K346V/A511S/I542S/Y582R, K346V/A511S/ S581L/Y582R, K346V/A511S/I583R, K346V/V529G/ S571I/S581C/Y582V/I583V/T589A, A511S/P537E, P516M/P539E/L568R, P537E/Y582R, P539E, L568R/ F662W/E663W, and S581L/Y582R, wherein the amino acid positions of the polypeptide sequence are numbered with reference to SEQ ID NO: 638 or 1532.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 638 or 1608, or a functional fragment thereof, and wherein the encoded recombinant protease comprises at least one substitution or substitution set at one or more positions selected from 346/511/537/582, 346/511/543/582, 346/511/544, 346/537/ 542/544, 346/543/544, 346/583, 511/537/542/582/583, 516, 516/539/555, 537/543/582, 539/568, 540, 542/544/581, 548, 549, 559, 559/568, 582, 647, 650, and 664, wherein the amino acid positions of the polypeptide sequence are numbered with reference to SEQ ID NO: 638 or 1608. In some embodiments, the encoded recombinant protease comprises at least one substitution or substitution set selected from 346V/511S/537E/582V, 346V/511S/543G/582R, 346V/ 511S/544L, 346V/537E/542S/544L, 346V/543G/544L, 346V/583R, 511S/537E/542S/582R/583R, 516M, 516M/ 539E/555G, 537E/543G/582R, 539E/568R, 540G, 542S/ 544L/581R, 548R, 549G, 559S, 559S/568R, 582V, 647L, 647W, 650G, and 664R, wherein the amino acid positions of the polypeptide sequence are numbered with reference to SEQ ID NO: 638 or 1608. In some embodiments, the encoded recombinant protease comprises at least one substitution or substitution set selected from K346V/A511S/ P537E/Y582V, K346V/A511S/F543G/Y582R, K346V/ A511S/T544L, K346V/P537E/I542S/T544L, K346V/ F543G/T544L, K346V/I583R, A511S/P537E/I542S/ Y582R/I583R, P516M, P516M/P539E/E555G, P537E/ F543G/Y582R, P539E/L568R, V540G, I542S/T544L/ S581R, D548R, V549G, L559S, L559S/L568R, Y582V, Q647L, Q647W, I650G, and Q664R, wherein the amino acid positions of the polypeptide sequence are numbered with reference to SEQ ID NO: 638 or 1608.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 680 or 1650, or a functional fragment thereof, and wherein the encoded recombinant protease comprises at least one substitution or substitution set at one or more positions selected from 261/355/543, 261/355/567/568, 261/489, 261/489/511/568, 261/489/539, 261/489/567, 261/539/543, 261/539/543/567, 261/542/543/568, 511, 511/539/543, 511/567, 543, and 583, wherein the amino acid positions of the polypeptide sequence are numbered with reference to SEQ ID NO: 680 or 1650. In some embodiments, the encoded recombinant protease comprises at least one substitution or substitution set selected from 261D/355C/543A, 261D/355C/567R/ 568R, 261D/489E, 261D/489E/511D/568R, 261D/489E/ 539L, 261D/489E/567R, 261D/539L/543A, 261D/539L/ 543D/567R, 261D/542L/543A/568R, 511D, 511D/539L/

543A, 511D/567R, 543A, and 583E, wherein the amino acid positions of the polypeptide sequence are numbered with reference to SEQ ID NO: 680 or 1650. In some embodiments, the encoded recombinant protease comprises at least one substitution or substitution set selected from L261D/L355C/F543A, L261D/L355C/D567R/L568R, L261D/D489E, L261D/D489E/A511D/L568R, L261D/D489E/P539L, L261D/D489E/D567R, L261D/P539L/F543A, L261D/P539L/F543D/D567R, L261D/I542L/F543A/L568R, A511D, A511D/P539L/F543A, A511D/D567R, F543A, and I583E, wherein the amino acid positions of the polypeptide sequence are numbered with reference to SEQ ID NO: 680 or 1650.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the encoded recombinant protease comprises at least one substitution or substitution set at one or more positions selected from 9, 9/17/34/35/93/554, 9/17/50, 9/17/93, 9/29/35/43/77/542/554, 9/32/77/93, 9/43/77, 9/50/63/93, 9/93, 17/29/34/35/36/77/93, 17/32/34/35, 17/77, 32/34/93, 43, 50/77/93, 50/93, 77/93, 93, 205/263/470, 205/344/470/565, 205/345/470/538/664, 205/470/545/568/645/647/664, 205/470/567/568/645, 263/344/664, 263/470/645, 263/489, 263/539/541/568/645, 344/355/470/489/645, 344/355/470/568/645/647, 344/470/489/539/542/645/647/664, 344/470/489/567/568, 344/470/568, 344/470/647, 470, 470/489, 470/541/542/543/565/645/647, 470/567/568, 470/664, and 542/543, wherein the amino acid positions of the polypeptide sequence are numbered with reference to SEQ ID NO: 756 or 1726. In some embodiments, the encoded recombinant protease comprises at least one substitution or substitution set selected from 9K, 9K/17A/34M/35G/93E/554M, 9K/17A/50S, 9K/17A/93E, 9K/29S/35G/43P/77D/542V/554M, 9K/32A/77D/93E, 9K/43P/77D, 9K/50S/63E/93E, 9K/93E, 9Q/17A/93E, 17A/29S/34M/35G/36D/77D/93E, 17A/32A/34M/35G, 17A/77D, 32A/34M/93E, 43P, 50S/77D/93E, 50S/93E, 77D/93E, 93E, 205L/263V/470Q, 205L/344V/470Q/565A, 205L/345P/470Q/538T/664R, 205L/470Q/545L/568R/645S/647W/664R, 205L/470Q/567R/568R/645S, 263E344V/664R, 263I/470Q/645S, 263I/489D, 263I/539L/541R/568R/645S, 344V/355C/470Q/489D/645S, 344V/355C/470Q/568R/645S/647W, 344V/470Q/489D/539L/542L/645S/647W/664R, 344V/470Q/489D/567R/568R, 344V/470Q/568R, 344V/470Q/647W, 470Q, 470Q/489D, 470Q/541R/542L/543A/565A/645S/647W, 470Q/567R/568R, 470Q/664R, and 542L/543A, wherein the amino acid positions of the polypeptide sequence are numbered with reference to SEQ ID NO: 756 or 1726. In some embodiments, the encoded recombinant protease comprises at least one substitution or substitution set selected from R9K, R9K/T17A/T34M/E35G/A93E/L554M, R9K/T17A/N50S, R9K/T17A/A93E, R9K/N29S/E35G/S43P/N77D/I542V/L554M, R9K/I32A/N77D/A93E, R9K/S43P/N77D, R9K/N50S/A63E/A93E, R9K/A93E, R9Q/T17A/A93E, T17A/N29S/T34M/E35G/T36D/N77D/A93E, T17A/I32A/T34M/E35G, T17A/N77D, I32A/T34M/A93E, S43P, N50S/N77D/A93E, N50S/A93E, N77D/A93E, A93E, R205L/R263V/P470Q, R205L/N344V/P470Q/N565A, R205L/Q345P/P470Q/S538T/Q664R, R205L/P470Q/I545L/L568R/K645S/Q647W/Q664R, R205L/P470Q/D567R/L568R/K645S, R263I/N344V/Q664R, R263I/P470Q/K645S, R263I/E489D, R263I/P539L/S541R/L568R/K645S, N344V/L355C/P470Q/E489D/K645S, N344V/L355C/P470Q/L568R/ K645S/Q647W, N344V/P470Q/E489D/P539L/I542L/K645S/Q647W/Q664R, N344V/P470Q/E489D/D567R/L568R, N344V/P470Q/L568R, N344V/P470Q/Q647W, P470Q, P470Q/E489D, P470Q/S541R/I542L/F543A/N565A/K645S/Q647W, P470Q/D567R/L568R, P470Q/Q664R, and I542L/F543A, wherein the amino acid positions of the polypeptide sequence are numbered with reference to SEQ ID NO: 756 or 1726.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 756 or 1726, or a functional fragment thereof, and wherein the encoded recombinant protease comprises at least one substitution or substitution set at one or more positions selected from 9/17/32/34/36/50/77/107/127, 9/17/63/77, 9/43/93/127, 9/63/93/107, 17/29/32/34/36/63, 29/34/35/77, 32/43/93, 35/93/145, and 205/263/489/647, wherein the amino acid positions of the polypeptide sequence are numbered with reference to SEQ ID NO: 756 or 1726. In some embodiments, the encoded recombinant protease comprises at least one substitution or substitution set selected from 9K/17A/32A/34M/36D/50S/77D/107K/127S, 9K/17A/63E/77D, 9K/43P/93E/127S, 9K/63E/93E/107K, 17A/29S/32A/34M/36D/63E, 29S/34M/35G/77D, 32A/43P/93E, 35G/93E/145E, and 205L/263V/489D/647W, wherein the amino acid positions of the polypeptide sequence are numbered with reference to SEQ ID NO: 756 or 1726. In some embodiments, the encoded recombinant protease comprises at least one substitution or substitution set selected from R9K/T17A/I32A/T34M/T36D/N50S/N77D/M107K/G127S, R9K/T17A/A63E/N77D, R9K/S43P/A93E/G127S, R9K/A63E/A93E/M107K, T17A/N29S/I32A/T34M/T36D/A63E, N29S/T34M/E35G/N77D, I32A/S43P/A93E, E35G/A93E/G145E, and R205L/R263V/E489D/Q647W, wherein the amino acid positions of the polypeptide sequence are numbered with reference to SEQ ID NO: 756 or 1726.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the encoded recombinant protease comprises at least one substitution or substitution set at one or more positions selected from 188, 189, 265, 266, 334, 442, 454, 646, and 649, wherein the amino acid positions of the polypeptide sequence are numbered with reference to SEQ ID NO: 812 or 1782. In some embodiments, the encoded recombinant protease comprises at least one substitution or substitution set selected from 188W, 189A, 189P, 265R, 266E, 266G, 334I, 442V, 454L, 454M, 454S, 646I, 646M, 646R, 649T, and 649Y, wherein the amino acid positions of the polypeptide sequence are numbered with reference to SEQ ID NO: 812 or 1782. In some embodiments, the encoded recombinant protease comprises at least one substitution or substitution set selected from N188W, K189A, K189P, G265R, N266E, N266G, V334I, L442V, A454L, A454M, A454S, V646I, V646M, V646R, D649T, and D649Y, wherein the amino acid positions of the polypeptide sequence are numbered with reference to SEQ ID NO: 812 or 1782.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the encoded recombinant protease comprises at least one substitution or substitution set at one or more positions selected from 189, 266, 266/283, 546, 594, and 646, wherein the amino acid positions of the polypeptide sequence are numbered with reference to SEQ ID NO: 812 or 1782. In some embodiments, the encoded recombinant protease comprises at least one substitution or substitution set selected from 189I, 266A, 266L, 266L/283K, 266M, 266S, 266V, 266W, 266Y, 546L, 594A, and 646L, wherein the amino acid positions of the polypeptide sequence are numbered with reference to SEQ ID NO: 812 or 1782. In some embodiments, the encoded recombinant protease comprises at least one substitution or substitution set selected from K189I, N266A, N266L, N266L/N283K, N266M, N266S, N266V, N266W, N266Y, V546L, V594A, and V646L, wherein the amino acid positions of the polypeptide sequence are numbered with reference to SEQ ID NO: 812 or 1782.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the encoded recombinant protease comprises at least one substitution or substitution set at one or more positions selected from 263/470/568, 266, 470/542/543/664, and 558/577/594, wherein the amino acid positions of the polypeptide sequence are numbered with reference to SEQ ID NO: 812 or 1782. In some embodiments, the encoded recombinant protease comprises at least one substitution or substitution set selected from 263I/470P/568R, 266R, 470P/542L/543A/664Q, and 558E/577V/594A, wherein the amino acid positions of the polypeptide sequence are numbered with reference to SEQ ID NO: 812 or 1782. In some embodiments, the encoded recombinant protease comprises at least one substitution or substitution set selected from R263I/Q470P/L568R, N266R, Q470P/I542L/F543A/R664Q, and T558E/D577V/V594A, wherein the amino acid positions of the polypeptide sequence are numbered with reference to SEQ ID NO: 812 or 1782.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 812 or 1782, or a functional fragment thereof, and wherein the encoded recombinant protease comprises at least one substitution or substitution set at one or more positions selected from 29, 29/35, 29/35/342/581/582/664, 29/50/511/539/581, 35, 35/50/205/406/511/581, 35/205/511, 35/342/346/511/539/581, 35/346, 35/346/406/511/581/582/664, 35/511, 35/539, 50/342, 132, 133, 143, 147, 187, 188, 257, 258, 263, 294, 294/441/527, 308/342/511/581/582, 342, 346, 398, 406/664, 429/652, 441, 441/446/526, 446/652, 482, 505, 511, 526, 527, 536, 545, 581, 582, 615, 620, 639, 645, 646, 648, 652, 654, and 664, wherein the amino acid positions of the polypeptide sequence are numbered with reference to SEQ ID NO: 812 or 1782. In some embodiments, the encoded recombinant protease comprises at least one substitution or substitution set selected from 29F, 29G, 29S/35G, 29S/35G/342L/581S/582Y/664Q, 29S/50S/511S/539L/581S, 35D/511S, 35G, 35G/50S/205S/406R/511S/581S, 35G/205S/511S, 35G/342L/346V/511S/539L/581S, 35G/346V, 35G/346V/406R/511S/581S/582Y/664Q, 35G/511S, 35G/539L, 50S/342L, 132T, 133V, 143H, 147T, 187G, 188T, 257L, 258H, 258N, 263S, 294A, 294A/441A/527A, 308A/342L/ 511S/581S/582Y, 342F, 346V, 398G, 406R/664Q, 429L/652T, 441A, 441A/446P/526L, 441V, 446P/652T, 482V, 505F, 505M, 51 IS, 526V, 527D, 527R, 536H, 536R, 545V, 581A, 581S, 582G, 582S, 582Y, 615Q, 620E, 639E, 639I, 645E, 645G, 645W, 646G, 646R, 648Q, 648V, 652L, 652Q, 652T, 652Y, 654C, 664G, 664V, and 664W, wherein the amino acid positions of the polypeptide sequence are numbered with reference to SEQ ID NO: 812 or 1782. In some embodiments, the encoded recombinant protease comprises at least one substitution or substitution set selected from N29F, N29G, N29S/E35G, N29S/E35G/R342L/L581S/R582Y/R664Q, N29S/N50S/A511S/P539L/L581S, E35D/A511S, E35G, E35G/N50S/R205S/K406R/A511S/L581S, E35G/R205S/A511S, E35G/R342L/K346V/A511S/P539L/L581S, E35G/K346V, E35G/K346V/K406R/A511S/L581S/R582Y/R664Q, E35G/A511S, E35G/P539L, N50S/R342L, I132T, L133V, E143H, A147T, I187G, N188T, R257L, K258H, K258N, R263S, R294A, R294A/R441A/K527A, E308A/R342L/A511S/L581S/R582Y, R342F, K346V, A398G, K406R/R664Q, K429L/K652T, R441A, R441A/R446P/R526L, R441V, R446P/K652T, R482V, A505F, A505M, A511S, R526V, K527D, K527R, W536H, W536R, I545V, L581A, L581S, R582G, R582S, R582Y, K615Q, V620E, T639E, T639I, K645E, K645G, K645W, V646G, V646R, R648Q, R648V, K652L, K652Q, K652T, K652Y, R654C, R664G, R664V, and R664W, wherein the amino acid positions of the polypeptide sequence are numbered with reference to SEQ ID NO: 812 or 1782.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1030 or 2000, or a functional fragment thereof, and wherein the encoded recombinant protease comprises at least one substitution or substitution set at one or more positions selected from 29, 29/143/263/266/441/639, 29/263/266, 29/263/266/441/620, 29/266/441, 29/441/639, 30, 37, 47/570, 75, 81, 85, 92, 135, 143, 143/263/266/639, 143/266/441/620/639, 168, 189/424, 237/527, 244, 258/342/582/648, 263, 263/266/441, 263/266/639, 266/441, 266/441/620/639, 266/620/639, 266/639, 267, 342/526/664, 342/545, 342/582, 429, 441, 482, 495, 501, 523, 526, 527, 568, 570, 573, 581, 582, 616, 632, 648, 653, and 654, wherein the amino acid positions of the polypeptide sequence are numbered with reference to SEQ ID NO: 1030 or 2000. In some embodiments, the encoded recombinant protease comprises at least one substitution or substitution set selected from 29G/143H/263S/266A/441V/639I, 29G/263S/266A, 29G/263S/266L/441A/620E, 29G/266A/441A, 29G/441V/639V, 29S, 30G, 37L, 47G/570E, 75N, 75S, 81N, 85L, 92L, 135E, 143H/263S/266A/639V, 143H/266A/441V/620E/639V, 143Q, 168E, 189Q/424G, 237E/527V, 244S, 258H/342F/582S/648Q, 263S/266A/441A, 263S/266A/441V, 263S/266A/639V, 263T, 266A/441V/620E/639V, 266A/620E/639I, 266A/639I, 266L/441A, 267G, 342F/526V/664G, 342F/545V, 342F/582G, 429P, 441E, 482V, 495L, 501Q, 523V, 526E, 527E, 527L, 527M, 527R, 527T, 568P, 570E, 573T, 581T, 582F, 616T, 632Q, 648A, 653I, and 654V, wherein the amino acid positions of the polypeptide sequence are numbered with reference to SEQ ID NO: 1030 or 2000. In some embodiments, the encoded recombinant protease comprises at least one substitution or substitution set selected from N29G/E143H/R263S/N266A/R441V/T639I, N29G/R263S/N266A, N29G/R263S/N266L/R441A/V620E, N29G/N266A/R441A, N29G/R441V/T639V, N29S, R30G, R37L, E47G/K570E, R75N, R75S, R81N, R85L, P92L, R135E, E143H/R263S/N266A/

T639V, E143H/N266A/R441V/V620E/T639V, E143Q, S168E, K189Q/D424G, D237E/K527V, R244S, K258H/ L342F/R582S/R648Q, R263S/N266A/R441A, R263S/ N266A/R441V, R263S/N266A/T639V, R263T, N266A/ R441V/V620E/T639V, N266A/V620E/T639I, N266A/ T639I, N266L/R441A, R267G, L342F/R526V/R664G, L342F/I545V, L342F/R582G, K429P, R441E, R482V, I495L, R501Q, M523V, R526E, K527E, K527L, K527M, K527R, K527T, L568P, K570E, K573T, S581T, R582F, K616T, K632Q, R648A, M653I, and R654V, wherein the amino acid positions of the polypeptide sequence are numbered with reference to SEQ ID NO: 1030 or 2000.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the encoded recombinant protease comprises at least one substitution or substitution set at one or more positions selected from 29, 29/30, 29/30/143/263/482/646, 29/30/263, 29/30/616/648, 29/75/263/568/570/648, 29/168/648, 29/263/527/568, 75, 75/143/168/527, 75/168, 75/616, 143, 168/247/482/648, 168/263/616, 168/482/616, 168/495/616, 263, 263/616, 429/ 545, 495, and 527, wherein the amino acid positions of the polypeptide sequence are numbered with reference to SEQ ID NO: 1136 or 2106. In some embodiments, the encoded recombinant protease comprises at least one substitution or substitution set selected from 29S, 29S/30G, 29S/30G/ 143Q/263T/482V/646E, 29S/30G/263T, 29S/30G/616T/ 648A, 29S/75S/263T/568P/570E/648A, 29S/168E/648A, 29S/263T/527L/568P, 75S, 75S/143Q/168E/527L, 75S/ 168E, 75S/616T, 143Q, 168E/247S/482V/648A, 168E/ 263T/616T, 168E/482V/616T, 168E/495L/616T, 263T, 263T/616T, 429P/545V, 495L, and 527T, wherein the amino acid positions of the polypeptide sequence are numbered with reference to SEQ ID NO: 1136 or 2106. In some embodiments, the encoded recombinant protease comprises at least one substitution or substitution set selected from N29S, N29S/R30G, N29S/R30G/E143Q/S263T/R482V/ V646E, N29S/R30G/S263T, N29S/R30G/K616T/R648A, N29S/R75S/S263T/L568P/K570E/R648A, N29S/S168E/ R648A, N29S/S263T/K527L/L568P, R75S, R75S/E143Q/ S168E/K527L, R75S/S168E, R75S/K616T, E143Q, S168E/ G247S/R482V/R648A, S168E/S263T/K616T, S168E/ R482V/K616T, S168E/I495L/K616T, S263T, S263T/ K616T, K429P/I545V, I495L, and K527T, wherein the amino acid positions of the polypeptide sequence are numbered with reference to SEQ ID NO: 1136 or 2106.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1136 or 2106, or a functional fragment thereof, and wherein the encoded recombinant protease comprises at least one substitution or substitution set at one or more positions selected from 207, 222, 266, 307, 454, 535, 546, 548, 580, 604, and 610, wherein the amino acid positions of the polypeptide sequence are numbered with reference to SEQ ID NO: 1136 or 2106. In some embodiments, the encoded recombinant protease comprises at least one substitution or substitution set selected from 207R, 222T, 266K, 307L, 454L, 535V, 546R, 548S, 580C, 604P, and 610R, wherein the amino acid positions of the polypeptide sequence are numbered with reference to SEQ ID NO: 1136 or 2106. In some embodiments, the encoded recombinant protease comprises at least one substitution or substitution set selected from Q207R, S222T, A266K, Q307L, A454L, E535V, V546R, D548S, H580C, H604P, and A610R, wherein the amino acid positions of the polypeptide sequence are numbered with reference to SEQ ID NO: 1136 or 2106.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1180 or 2150, or a functional fragment thereof, and wherein the encoded recombinant protease comprises at least one substitution or substitution set at one or more positions selected from 75/168/207/454/568/586/610/648/659, 75/168/266/454/ 546/570/580, 75/207/454/570/659, 75/207/546/580/648, 75/263/454/548/568/604/648, 75/266/454, 75/454, 75/454/ 546/548/568/604, 75/546/548/610/648, 168/207/263/454/ 568/570/604, 168/263/266/546/604, 168/454/604, 207/604/ 610, 209, 212, 221, 223, 228, 266/454/568, 319, 373, 412/546/554, 431, 454, 454/546/568/570/580, 454/546/570, 454/570/580/610, 454/580, 454/659, and 506, wherein the amino acid positions of the polypeptide sequence are numbered with reference to SEQ ID NO: 1180 or 2150. In some embodiments, the encoded recombinant protease comprises at least one substitution or substitution set selected from 75S/168E/207R/454L/568P/586V/610R/648A/659T, 75S/ 168E/266K/454L/546R/570E/580C, 75S/207R/454L/570E/ 659T, 75S/207R/546R/580C/648A, 75S/263T/454L/548S/ 568P/604P/648A, 75S/266K/454L, 75S/454L, 75S/454L/ 546R/548S/568P/604P, 75S/546R/548S/610R/648A, 168E/ 207R/263T/454L/568P/570E/604P, 168E/263T/266K/ 546R/604P, 168E/454L/604P, 207R/604P/610R, 209V, 212S, 221I, 223Q, 228I, 228V, 266K/454L/568P, 319Q, 373F, 412Y/546L/554M, 431T, 454I, 454L/546R/568P/ 570E/580C, 454L/546R/570E, 454L/570E/580C/610R, 454L/580C, 454L/659T, and 506N, wherein the amino acid positions of the polypeptide sequence are numbered with reference to SEQ ID NO: 1180 or 2150. In some embodiments, the encoded recombinant protease comprises at least one substitution or substitution set selected from R75S/ S168E/Q207R/A454L/L568P/L586V/A610R/R648A/ E659T, R75S/S168E/A266K/A454L/V546R/K570E/ H580C, R75S/Q207R/A454L/K570E/E659T, R75S/Q207R/ V546R/H580C/R648A, R75S/S263T/A454L/D548S/ L568P/H604P/R648A, R75S/A266K/A454L, R75S/A454L, R75S/A454L/V546R/D548S/L568P/H604P, R75S/V546R/ D548S/A610R/R648A, S168E/Q207R/S263T/A454L/ L568P/K570E/H604P, S168E/S263T/A266K/V546R/ H604P, S168E/A454L/H604P, Q207R/H604P/A610R, I209V, D212S, L221I, N223Q, T228I, T228V, A266K/ A454L/L568P, N319Q, L373F, F412Y/V546L/L554M, P431T, A454I, A454L/V546R/L568P/K570E/H580C, A454L/V546R/K570E, A454L/K570E/H580C/A610R, A454L/H580C, A454L/E659T, and G506N, wherein the amino acid positions of the polypeptide sequence are numbered with reference to SEQ ID NO: 1180 or 2150.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1250 or 2220, or a functional fragment thereof, and wherein the encoded recombinant protease comprises at least one substitution or substitution set at one or more positions selected from 75/189/373/582, 75/200/212/431/482, 75/212/373/431/482, 75/212/431/482/568/615/664, 75/368/582, 75/373/431/526/ 582, 75/431/482/570/604/664, 75/632, 189/212/431/568/

570, 200/205/373/431, 200/431/482/615/664, 200/482/664, 212/228/431, 212/228/568/570/582/664, 212/373/446/482/582, 368/373/431, 373/431/570/604/664, 373/568/632, 431, 431/604/664, 482/582, 582, and 615/652/664, wherein the amino acid positions of the polypeptide sequence are numbered with reference to SEQ ID NO: 1250 or 2220. In some embodiments, the encoded recombinant protease comprises at least one substitution or substitution set selected from 75S/189A/373F/582G, 75S/200W/212S/431T/482S, 75S/212S/373F/431T/482S, 75S/212S/431T/482S/568P/615M/664G, 75S/368M/582G, 75S/373F/431T/526E/582G, 75S/431T/482S/570K/604P/664G, 75S/632Q, 189A/212S/431T/568P/570K, 200W/205S/373F/431T, 200W/431T/482S/615M/664G, 200W/482S/664W, 212S/228V/431T, 212S/228V/568P/570K/582G/664W, 212S/373F/446F/482S/582G, 368M/373F/431T, 373F/431T/570K/604P/664W, 373F/568P/632Q, 431T, 431T/604P/664G, 482S/582G, 582G, and 615M/652V/664G, wherein the amino acid positions of the polypeptide sequence are numbered with reference to SEQ ID NO: 1250 or 2220. In some embodiments, the encoded recombinant protease comprises at least one substitution or substitution set selected from R75S/K189A/L373F/R582G, R75S/K200W/D212S/P431T/R482S, R75S/D212S/L373F/P431T/R482S, R75S/D212S/P431T/R482S/L568P/K615M/R664G, R75S/K368M/R582G, R75S/L373F/P431T/R526E/R582G, R75S/P431T/R482S/E570K/H604P/R664G, R75S/K632Q, K189A/D212S/P431T/L568P/E570K, K200W/R205S/L373F/P431T, K200W/P431T/R482S/K615M/R664G, K200W/R482S/R664W, D212S/T228V/P431T, D212S/T228V/L568P/E570K/R582G/R664W, D212S/L373F/R446F/R482S/R582G, K368M/L373F/P431T, L373F/P431T/E570K/H604P/R664W, L373F/L568P/K632Q, P431T, P431T/H604P/R664G, R482S/R582G, R582G, and K615M/K652V/R664G, wherein the amino acid positions of the polypeptide sequence are numbered with reference to SEQ ID NO: 1250 or 2220.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 1308 or 2278, or a functional fragment thereof, and wherein the encoded recombinant protease comprises at least one substitution or substitution set at one or more positions selected from 408/439, 439/514, 470, 470/667, 514, 514/537, and 537, wherein the amino acid positions of the polypeptide sequence are numbered with reference to SEQ ID NO: 1308 or 2278. In some embodiments, the encoded recombinant protease comprises at least one substitution or substitution set selected from 408A/439S, 439S/514R, 470G, 470G/667D, 470P, 514R, 514R/537E, and 537E, wherein the amino acid positions of the polypeptide sequence are numbered with reference to SEQ ID NO: 1308 or 2278. In some embodiments, the encoded recombinant protease comprises at least one substitution or substitution set selected from V408A/M439S, M439S/H514R, Q470G, Q470G/G667D, Q470P, H514R, H514R/P537E, and P537E, wherein the amino acid positions of the polypeptide sequence are numbered with reference to SEQ ID NO: 1308 or 2278.

In some embodiments, the polynucleotide encodes a recombinant protease comprising a polypeptide sequence having at least 80%, 85%, 86%, 87%, 88%, 89%, 90%, 91%, 92%, 93%, 94%, 95%, 96%, 97%, 98%, 99%, or more sequence identity to SEQ ID NO: 34, 190, 292, 342, 382, 400, 454, 562, 638, 680, 756, 812, 1030, 1136, 1180, 1250, 1308, 1364, 1370, 1424, 1532, 1608, 1650, 1726, 1782, 2000, 2106, 2150, 2220, 2278, or 2332. In some embodiments, the polynucleotide encodes a recombinant protease comprising a polypeptide sequence of SEQ ID NO: 34, 190, 292, 342, 382, 400, 454, 562, 638, 680, 756, 812, 1030, 1136, 1180, 1250, 1308, 1364, 1370, 1424, 1532, 1608, 1650, 1726, 1782, 2000, 2106, 2150, 2220, 2278, or 2332.

In some embodiments, the polynucleotides are capable of hybridizing under highly stringent conditions to a reference polynucleotide sequence. In some embodiments, the reference sequence is selected from SEQ ID NOS: 1, 33, 189, 2, 291, 341, 381, 399, 453, 561, 637, 679, 755, 811, 1029, 1135, 1179, 1249, and/or 1307, or a complement thereof, or a polynucleotide sequence encoding any of the variant protease polypeptides provided herein. In some embodiments, the polynucleotide capable of hybridizing under highly stringent conditions encodes a protease polypeptide comprising an amino acid sequence that has one or more residue differences as compared to SEQ ID NO: 1, 33, 189, 2, 291, 341, 381, 395, 399, 453, 561, 637, 679, 755, 811, 1029, 1135, 1179, 1249, 1307, 1365, 1369, 1423, 1531, 1607, 1649, 1725, 1781, 1999, 2105, 2149, 2219, and/or 2277 at residue positions selected from any positions as set forth in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27. In some further embodiments, the engineered polynucleotide is selected from those provided in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, or in Tables 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the engineered nucleotides is absent the sequences encoding the histidine tag and preceding amino acid linker; or comprises a polynucleotide having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a reference sequence selected from SEQ ID NO: 1, 33, 189, 2, 291, 341, 381, 395, 399, 453, 561, 637, 679, 755, 811, 1029, 1135, 1179, 1249, 1307, 1365, 1369, 1423, 1531, 1607, 1649, 1725, 1781, 1999, 2105, 2149, 2219, and/or 2277. In some additional embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence provided in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, and/or SEQ ID NO: 1, 33, 189, 2, 291, 341, 381, 395, 399, 453, 561, 637, 679, 755, 811, 1029, 1135, 1179, 1249, 1307, 1365, 1369, 1423, 1531, 1607, 1649, 1725, 1781, 1999, 2105, 2149, 2219, and/or 2277. In some further embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence selected from odd numbered SEQ ID NOS: 3 to 1361 and 1365-2331. In some further embodiments, the polynucleotide comprises a sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or more sequence identity to at least one polynucleotide sequence selected from odd numbered SEQ ID NOS: 1365 to 2331. In some further embodiments, the polynucleotide comprises a sequence selected from odd numbered SEQ ID NOS: 3 to 1361 and 1365-2331. In some further embodiments, the polynucleotide comprises a sequence selected from odd numbered SEQ ID NOS: 1365 to 2331. In some further embodiments, the engineered polynucleotide sequence comprises 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 base changes, as compared to a reference polynucleotide sequence. In still some other embodiments, the engineered polynucleotide sequence comprises 1, 2, 3, 4, 5, 6, 7, 8, 9, 10, 11, 12, 13, 14, 15, 16, 17, 18, 19, 20, 21, 22, 23, 24, 25, 30, 31, 32, 33, 34, 35, 40, 45, or 50 base changes, as compared to a reference polynucleotide sequence. In some embodiments, the engineered polynucleotide sequence comprises 1, 2, 3, 4, 5, 6, 7, 8, 9, 10, 11, 12, 13, 14, 15, 16, 18, 20, 21, 22, 23, 24, or 25 base changes, as compared to a reference polynucleotide sequence.

In some embodiments, an isolated polynucleotide encoding any of the engineered protease polypeptides provided herein is manipulated in a variety of ways to provide for expression of the gene and production of the polypeptide. In some embodiments, the polynucleotides encoding the polypeptides are provided as expression vectors, in which one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable control sequences can be selected based on the host cells used. It is not intended that the present invention be limited to any specific control sequences.

Exemplary promoters for bacterial host cells include, but are not limited to promoters obtained from the genes for *Escherichia coli* lactose operon, tryptophan operon, arabinose operon, T7 promoter from the T7 bacteriophage, and the *Saccharopolyspora erythraea* erythromycin resistance gene.

Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase, *Rhizomucor miehei* protease, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]). Exemplary promoters for use in mammalian cells include, but are not limited to those from cytomegalovirus (CMV), Simian vacuolating virus 40 (SV40), from *Homo sapiens* phosphoglycerate kinase, beta actin, elongation factor-1a or glyceraldehyde-3-phosphate dehydrogenase, or from *Gallus'* β-actin.

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for bacterial host cells can be obtained from the T7 bacterial phage for the T7 terminator, or *Escherichia coli* ribosomal RNA, for example the rrnB terminator. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra). Exemplary terminators for mammalian cells include, but are not limited to those from cytomegalovirus (CMV), Simian vacuolating vims 40 (SV40), or from *Homo sapiens* growth hormone.

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Biol., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence.

Any signal peptide coding region that directs the expressed polypeptide into the secretory pathway of a host cell of choice finds use for expression of the engineered protease polypeptides provided herein. Effective signal peptide coding regions for filamentous fungal host cells include, but are not limited to, the signal peptide coding regions obtained from the genes for Aspergillus oryzae TAKA amylase, Aspergillus niger neutral amylase, Aspergillus niger glucoamylase, Rhizomucor miehei aspartic proteinase, Humicola insolens cellulase, and Humicola lanuginosa protease. Useful signal peptides for yeast host cells include, but are not limited to those from the genes for Saccharomyces cerevisiae alpha-factor and Saccharomyces cerevisiae invertase. Useful signal peptides for mammalian host cells include but are not limited to those from the genes for immunoglobulin gamma (IgG).

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide.

In another aspect, the present invention also provides a recombinant expression vector comprising a polynucleotide encoding an engineered protease polypeptide, and one or more expression regulating regions such as a promoter and a terminator, a replication origin, etc., depending on the type of hosts into which they are to be introduced, in some embodiments, the various nucleic acid and control sequences described above are joined together to produce a recombinant expression vector which includes one or more convenient restriction sites to allow for insertion or substitution of the nucleic acid sequence encoding the variant protease polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant protease polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells.

A "selectable marker" is a gene the product of which provides for biocide or viral resistance, resistance to heavy metals, prototrophy to auxotrophs, and the like. Suitable markers for bacterial host cells include, but are not limited to carbenicillin, ampicillin, chloramphenicol, tetracyclin, kanamycin and zeocin.

Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered protease polypeptide of the present application, the polynucleotide being operatively linked to one or more control sequences for expression of the engineered protease enzyme(s) in the host cell.

Host cells for use in expressing the polypeptides encoded by the expression vectors of the present invention are well known in the art and include but are not limited to, bacterial cells (e.g., E. coli): fungal cells, such as yeast cells (e.g., Saccharomyces cerevisiae and Pichia pastoris [e.g., ATCC Accession No. 201178]); insect cells (e.g., Drosophila S2 and Spodoptera Sf9 cells), plant cells, animal cells (e.g., CHO, COS, and BHK), and human cells (e.g., HEK293T, human fibroblast, THP-1, Jurkat and Bowes melanoma cell lines).

Accordingly, in another aspect, the present invention provides methods for producing the engineered protease polypeptides, where the methods comprise culturing a host cell capable of expressing a polynucleotide encoding the engineered protease polypeptide under conditions suitable for expression of the polypeptide. In some embodiments, the methods further comprise the steps of isolating and/or purifying the protease polypeptides, as described herein.

Appropriate culture media and growth conditions for the above-described host cells are well known in the art. Polynucleotides for expression of the protease may be introduced into cells by various methods known in the art. Techniques include, among others, electroporation, biolistic particle bombardment, liposome mediated transfection, calcium chloride transfection, and protoplast fusion.

The engineered protease with the properties disclosed herein can be obtained by subjecting the polynucleotide encoding the naturally occurring or engineered protease polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA., 1994, 91:10747-10751; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See, e.g., Zhao et al., Nat. Biotechnol., 1998, 16:258-261), mutagenic PCR (See e.g., Caldwell et al., PCR Methods Appl., 3:S136-S140, 1994), and cassette mutagenesis (See, e.g., Black et al., Proc. Natl. Acad. Sci. USA., 1996, 93:3525-3529).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 8,849,575, 9,593,326, 9,665,694, 9,684,771, 9,864,833, 9,996,661, and all related US, as well as PCT and non-US counterparts; Ling et al., Anal. Biochem., 254(2): 157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme variants obtained following mutagenesis treatment are screened by subjecting the enzyme variants to a defined temperature (or other assay conditions) and measuring the amount of enzyme activity remaining after heat treatments or other assay conditions. DNA containing the polynucleotide encoding the protease polypeptide is then isolated from the host cell, sequenced to identify the nucleotide sequence changes (if any), and used to express the enzyme in a different or the same host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors. However, it is not intended that the present invention be limited to any specific method for production of polynucleotides and oligonucleotides, as any suitable method finds use in the present invention.

Accordingly, in some embodiments, a method for preparing the engineered protease polypeptide can comprise: (a) synthesizing a polynucleotide encoding a polypeptide comprising an amino acid sequence selected from the amino acid sequence of any variant provided in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, 3.27 (e.g., even numbered sequences of SEQ ID NOS: 4-1362), or Table 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27, wherein the variant lacks the histidine tag and preceding amino acid linker (e.g., even numbered sequences of SEQ ID NOS: 1366-2332): as well as SEQ ID NOS: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and 2278; and (b) expressing the protease polypeptide encoded by the polynucleotide. In some embodiments of the method, the amino acid sequence encoded by the polynucleotide comprises one or several (e.g., up to 3, 4, 5, or up to 10) amino acid residue deletions, insertions and/or substitutions. In some embodiments, the amino acid sequence comprises 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence comprises 1, 2, 3, 4, 5, 6, 7, 8, 9, 10, 11, 12, 13, 14, 15, 16, 17, 18, 19, 20, 21, 22, 23, 24, 25, 30, 31, 32, 33, 34, 35, 40, 41, 42, 43, 44, 45, 46, 47, 48, 49, or 50 amino acid residue deletions, insertions and/or substitutions. In some embodiments, the amino acid sequence comprises 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered protease polypeptide can be assessed for any desired improved property (e.g., activity, selectivity, stability, acid tolerance, protease sensitivity, etc.), using any suitable assay known in the art, including but not limited to the assays and conditions described herein.

In some embodiments, any of the engineered protease polypeptides expressed in a host cell are recovered from the cells and/or the culture medium using any one or more of the well-known techniques for protein purification, including, among others, lysozyme treatment, sonication, filtration, salting-out, heat treatment, ultra-centrifugation, and chromatography.

Chromatographic techniques for isolation of the protease polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant protease enzymes. In some embodiments utilizing affinity chromatography purification, any antibody which specifically binds the variant protease polypeptide finds use.

In some embodiments utilizing affinity chromatography purification, proteins that bind to the glycans covalently attached to protease find use. In still other embodiments utilizing affinity-chromatography purifications, any small molecule that binds to the protease active site finds use. For the production of antibodies, various host animals, including but not limited to rabbits, mice, rats, etc., are immunized by injection with a polypeptide (e.g., a protease variant), or a fragment thereof. In some embodiments, the protease polypeptide or fragment is attached to a suitable carrier, such as BSA, by means of a side chain functional group or linkers attached to a side chain functional group.

In some embodiments, the engineered protease polypeptide is produced in a host cell by a method comprising culturing a host cell (e.g., E. coli, S. cerevisiae, Daucus carota, Nicotiana tabacum, H. sapiens (e.g., HEK293T), or Cricetulus griseus (e.g., CHO)) comprising a polynucleotide sequence encoding an engineered protease polypeptide as described herein under conditions conducive to the production of the engineered protease polypeptide and recovering the engineered protease polypeptide from the cells and/or culture medium.

In some embodiments, the invention encompasses a method of producing an engineered protease polypeptide comprising culturing a recombinant eukaryotic cell comprising a polynucleotide sequence encoding an engineered protease polypeptide having at least 80%, 81%, 82%, 83%, 84%, 85%, 86%, 87%, 88%, 89%, 90%, 95%, 96%, 97%, 98%, 99%, or 100% sequence identity to a reference sequence (e.g., SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278).

In some embodiments, the invention encompasses a method of producing an engineered protease polypeptide comprising culturing a recombinant eukaryotic cell comprising a polynucleotide sequence encoding an engineered protease polypeptide having at least 80%, 81%, 82%, 83%, 84%, 85%, 86%, 87%, 88%, 89%, 90%, 95%, 96%, 97%, 98%, 99%, or 100% sequence identity to a reference sequence (e.g., SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278) and one or more amino acid residue differences as compared to SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278, selected from those provided in Table 3.1, 3.2, 3.3, 3.4, 3.5, 3.6, 3.7, 3.8, 3.9, 3.10, 3.11, 3.12, 3.13, 3.14, 3.15, 3.16, 3.17, 3.18, 3.19, 3.20, 3.21, 3.22, 3.23, 3.24, 3.25, 3.26, and/or 3.27 (e.g., even numbered sequences of SEQ ID NOS:4-1362 and 1366-2332), and/or combinations thereof when optimally aligned with the amino acid sequence of SEQ ID NO: 2, 34, 190, 292, 342, 382, 396, 400, 454, 562, 638, 680, 756, 812, 1030, 1136, 1180, 1250, 1308, 1366, 1370, 1424, 1532, 1608, 1650, 1726, 1782, 2000, 2106, 2150, 2220, and/or 2278 under suitable culture conditions to allow the production of the engineered protease polypeptide and optionally recovering the engineered protease polypeptide from the culture and/or cultured bacterial cells.

In some embodiments, once the engineered polypeptides are recovered from the recombinant host cells or cell culture medium, they are further purified by any suitable method(s) known in the art. In some additional embodiments, the purified protease polypeptides are combined with other ingredients and compounds to provide compositions and formulations comprising the engineered protease polypeptide as appropriate for different applications and uses (e.g., pharmaceutical compositions). In some additional embodiments, the purified polypeptides, or the formulated protease polypeptides are lyophilized.

Compositions and Uses

The present invention provides various compositions and formats, including but not limited to those described below. In some embodiments, the present invention provides engineered protease polypeptides suitable for use in pharmaceutical and other compositions, such as dietary and/or nutritional supplements.

Depending on the mode of administration, these compositions comprising a therapeutically effective amount of an engineered protease according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered protease polypeptides are formulated for use in pharmaceutical compositions. Any suitable format for use in delivering the engineered protease polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, solutions, suspensions (including but not limited to oil-based suspensions, oil-in water emulsions, etc.), slurries, syrups, controlled release formulations, suppositories, etc. In some embodiments, the engineered protease polypeptides are provided in a format suitable for injection or infusion (i.e., in an injectable formulation). In some embodiments, the engineered protease polypeptides are provided in biocompatible matrices such as sol-gels, including silica-based (e.g., oxysilane) sol-gels. In some embodiments, the engineered protease polypeptides are encapsulated and/or enterically coated. In some alternative embodiments, the engineered protease polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered protease polypeptides be administered by any suitable means known in the art, including but not limited to parenteral, oral, topical, transdermal, intranasal, intraocular, intrathecal, via implants, etc.

In some embodiments, the engineered protease polypeptides are chemically modified by glycosylation, chemical crosslinking reagents, pegylation (i.e., modified with polyethylene glycol [PEG] or activated PEG, etc.) or other compounds (See, e.g., Ikeda, Amino Acids, 2005, 29:283-287; U.S. Pat. Nos. 7,531,341, 7,534,595, 7,560,263, and 7,553,653; US Pat. Appln. Publ. Nos. 2013/0039898, 2012/0177722, etc.). Indeed, it is not intended that the present invention be limited to any particular delivery method and/or mechanism.

In some additional embodiments, the engineered protease polypeptides are provided in formulations comprising matrix-stabilized enzyme crystals. In some embodiments, the formulation comprises a cross-linked crystalline engineered protease enzyme and a polymer with a reactive moiety that adheres to the enzyme crystals. The present invention also provides engineered protease polypeptides in polymers.

In some embodiments, compositions comprising the engineered protease polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxymethylcellulose), gums (e.g., arabic, tragacanth, guar, etc.), and/or proteins (e.g., gelatin, collagen, etc.).

In some embodiments, the engineered protease polypeptide is suitable for use to improve dietary protein digestion. In some further embodiments, the engineered protease polypeptide finds use in breaking down protein in food and feed, prior to the consumption of the food or feed. The dosage of engineered protease polypeptide(s) administered depends upon the condition or disease, the general condition of the subject, and other factors known to those in the art. In some embodiments, the compositions are intended for single or multiple administrations. In some embodiments, it is contemplated that the concentration of engineered protease polypeptide(s) in the composition(s) administered to a subject with pancreatic insufficiency disease is sufficient to effectively treat, and/or ameliorate disease (e.g., pancreatic insufficiency disease). In some embodiments, the subject is a human, also referred to herein as a patient. In some embodiments, the subject is a non-human mammal, such as a non-human primate, pigs, cows, goats, dogs, and cats. In some embodiments, the engineered protease polypeptides find use in combination with other enzymes, such as amylases and/or lipases, for the treatment of diseases such as pancreatic enzyme insufficiency.

In some embodiments, the engineered protease polypeptides are administered in combination with other pharmaceutical and/or dietary compositions, including but not limited to dietary supplements, nutraceuticals, etc. It is not intended that the present invention be limited to any specific method or form of administration, as any suitable method and/or form finds use.

EXAMPLES

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and µM (micromolar); nM (nanomolar); mol (moles); gm and g (gram); mg (milligrams); ug and µg (micrograms); L and l (liter); ml and mL (milliliter); cm (centimeters); mm (millimeters); um and µm (micrometers); sec. (seconds); min(s) (minute(s)); h(s) and hr(s) (hour(s)); kDa (kilodaltons); U (units); MW (molecular weight); rpm (rotations per minute); ° C. (degrees Centigrade); CDS (coding sequence); DNA (deoxyribonucleic acid); RNA (ribonucleic acid); E. coli W3110 (commonly used laboratory E. coli strain, available from the Coli Genetic Stock Center [CGSC], New Haven, CT); EPI (exocrine pancreatic insufficiency); btLIP (B. thermoamylovorans lipase); HPLC (high pressure liquid chromatography); ms (mass spectrometry or mass spectroscopy); SDS-PAGE (sodium dodecyl sulfate polyacrylamide gel electrophoresis); PES (polyethersulfone); ACN (acetonitrile); IPA (isopropyl alcohol); IPTG (isopropyl β-D-1-thiogalactopyranoside); PBS (phosphate buffered saline); PMBS (polymyxin B sulfate); NADPH (nicotinamide adenine dinucleotide phosphate); LB (Luria broth); MeOH (methanol); FIOPC and FIOP (fold improvements over positive control); HTP (high throughput); CAV (cell accelerator voltage; collision cell accelerator voltage); CE (collision energy); RF (radio frequency); Greiner (Greiner Bio-One North America, Inc., Monroe, NC); Bio-rad (Bio-Rad Laboratories, Inc., Hercules, CA); Sigma-Aldrich (Sigma-Aldrich, St. Louis, MO); Pall Corp. (Pall, Corp., Pt. Washington, NY); Millipore (Millipore, Corp., Billerica MA); Difco (Difco Laboratories, BD Diagnostic Systems, Detroit, MI); Molecular Devices (Molecular Devices, LLC, Sunnyvale, CA); Kuhner (Adolf Kuhner, AG, Basel, Switzerland); Applied Biosystems (Applied Biosystems, part of Life Technologies, Corp., Grand Island, NY), Agilent (Agilent Technologies, Inc., Santa Clara, CA); RAPIDFIRE® MS (RAPIDFIRE® mass spectrometer, Agilent); Thermo Scientific (part of ThermoFisher Scientific, Waltham, MA); Gibco (ThermoFisher Scientific); Pierce (Pierce Biotechnology (now part of Thermo Fisher Scientific), Rockford, IL); ThermoFisher Scientific (Thermo Fisher Scientific, Waltham, MA); Corning (Corning, Inc., Palo Alto, CA); AbbVie (AbbVie, Inc., North Chicago, IL); Jackson (The Jackson Laboratory, Bar Harbor, ME); and Bio-Rad (Bio-Rad Laboratories, Hercules, CA); and Graph-Pad (GraphPad Software, San Diego, CA).

Example 1: Protease Gene Acquisition and Construction of Expression Vectors

The DNA sequence encoding wild-type protease (WP_015180421.1) ("WT Pro_16") of *Microcoleus* sp (SEQ ID NO: 2), from the peptidase S8 family was codon optimized for expression in *E. coli*, and cloned into the *E. coli* expression vector pCK110900 vector system (See e.g., U.S. Pat. Nos. 7,629,157, and 9,714,437, and US Pat. Appln. Publn. 2006/0195947, all of which are hereby incorporated by reference herein) or pJV110900 vector system (See e.g., US Pat. Appln Publ. 2017/213758, hereby incorporated by reference). However, it is not intended that the present invention be limited to any specific vectors. In addition, in some embodiments, expression vectors lacking antimicrobial resistance markers are used. In some of the constructs, a C-terminal 6×His-tag was added to the protease variants. The plasmid construct was transformed into an *E. coli* strain derived from W3110. Directed evolution techniques generally known by those skilled in the art were used to generate libraries of gene variants from this plasmid construct (See e.g., U.S. Pat. No. 8,383,346, and WO2010/144103) as well as its derivatives.

Example 2: High-Throughput (HTP) Growth of Protease Variants and Screening Conditions Methods used to grow cells producing the proteases of the present invention, as well as screening methods to characterize the proteases are provided in this Example.

High-Throughput (HTP) Growth of *Microcoleus* sp. Protease ("WT Pro 16") and Variants Transformed *E. coli* cells were selected by plating onto LB agar plates containing 1% glucose with selection. After overnight incubation at 37° C., colonies were placed into the wells of 96-well shallow flat bottom plates (NUNC™, Thermo-Scientific) filled with 180 µl/well LB supplemented with 1% glucose and selection (e.g., chloramphenicol). The cultures were allowed to grow overnight for 18-20 hours in a shaker incubator (200 rpm, 30° C., and 85% relative humidity; Kuhner).

Overnight growth samples (20 µL) were transferred into COSTAR® 96-well deep plates filled with 380 µL of Terrific Broth supplemented with a selection marker. The plates were incubated for 135 minutes in a shaker (250 rpm, 30° C., and 85% relative humidity; Kuhner). The expression of the lipase variants was then induced with 40 µL of 10 mM IPTG in sterile water and the cultures were incubated overnight for 20-24 hours in a shaker (250 rpm, 30° C., and 85% relative humidity; Kuhner). The cells were pelleted by centrifugation (4000 rpm×20 min), the supernatants were discarded, and the cells were frozen at −80° C. prior to analysis.

Lysis of HTP Pellets

First, 200 µL of lysis buffer (IX PBS, 1 mg/ml lysozyme, and 0.5 mg/ml polymyxin B sulfate) were added to the cell pellets. The cell pellet and buffer were gently shaken for 1.5-2 h at room temperature, and centrifuged (4000 rpm×15 min) prior to use of the clarified lysates in the various HTP assays described herein. Analysis of these lysates by SDS-PAGE revealed the presence of overexpressed protein bands at an apparent MW of ~52 kDa and ~22 kDa, consistent with the expected MW of the mature active protease and the cleaved pro domain respectively. In some experiments, additional dilutions of clarified lysate were performed with PBS buffer prior to challenges and analysis.

Purification of Protease Variants for Analysis

To purify His-tagged variants, clarified cell lysate was purified with HisPur Ni-NTA spin plates (Thermo Fisher Scientific) and Zeba desalting plates (Thermo Fisher Scientific) according to the manufacturer's protocols. Purified protein was eluted and desalted in PBS buffer.

Analysis of Clarified Lysates or Purified Protein for Protease Activity

The activity of the variant proteases produced during the development of the present invention was determined by measuring the degradation of Casein using the EnzChek® Protease Assay Kit (Thermo Fisher Scientific). For this assay, 90 µL of 5 µg/mL or 10 µg/mL BODIPY® FL-casein substrate in aqueous buffer (100 mM NaPO$_4$, pH 6-7; or 10 mM Tris-HCl, pH 7.8) was added to a 96-well, opaque, black microtiter plate (COSTAR® plate). To start the assay, 10 µL of sample (cell lysate or purified protease) was added to the reaction mix and mixed. Plates were immediately read on a SPECTRAMAX® M2 microplate reader (Molecular Devices) for kinetic fluorescence (Excitation: 485, Emission: 530, 3 minutes). The slope was calculated over the linear range, generally 3 minutes, to assess protease activity. To ensure that samples did not saturate the assay, samples were diluted in assay buffer prior to analysis based on a pre-determined dilution factor (up to 256×), as needed. The term "unchallenged activity" is defined as protease activity without any external challenge described in the following assay method descriptions. This assay is the default protease activity assay described in the Examples herein, unless stated otherwise.

Alternate Method for HTP Analysis of Clarified Lysates or Purified Proteins for Protease Activity In some experiments, an alternate activity assay was used. For this assay, 187 µL of 0.086 g/L Na-Benzyol-L-arginine ethyl ester (BAEE) in 100 mM NaPO$_4$ buffer, pH 7.5, was added to a clear flat-bottomed plate (Greiner UV-STAR® microplate). Next 8 µL of 1 mM hydrochloric acid was added to the plates. To start the reaction, 5 µL of sample was added to the reaction mix. Plates were immediately read on a SPECTRAMAX® M2 microplate reader (Molecular Devices) for kinetic absorbance (A253, 200s). The slope was calculated over the linear range of the profile.

HTP Analysis of Clarified Lysates or Purified Proteins Pre-Incubated with a Heat Challenge Thermostability of the variant protease variants was assessed as described in this Example. Clarified lysate was transferred to a PCR plate (Biorad) and incubated for 1 hour at 40-50° C., in a thermocycler. After incubation, samples were centrifuged to pellet heat-precipitated proteins and the supernatants were analyzed for protease residual activity as described herein.

HTP Analysis of Clarified Lysates or Purified Proteins Pre-Incubated at Low pH and/or Exposed to Pepsin The activities of the variant protease variants were determined after pre-incubation either at low pH, or at low pH in the presence of pepsin to simulate the environment of the stomach. First, clarified lysate was mixed 1:1 with McIlvaine buffer, pH 2.0-4.0, with 0-3.0 mg/mL pepsin from porcine gastric mucosa (Sigma) added, in a PCR plate (Biorad), for a final challenge pH of 2.0-4.0 and a final pepsin concentration of up to 1.5 mg/mL. Samples were mixed then incubated for 1-2 hrs at 37° C. in a thermocycler. To quench the reactions, samples were mixed 1:1 with 400 mM NaPO$_4$, pH 6.0-7.0, thereby neutralizing the pH and inactivating the pepsin. Neutralized challenge samples were then analyzed for protease residual protease activity as described herein.

HTP Evaluation of Autolysis Stability of Purified Proteins

To assess the extent of autolysis of the protease variants, purified protease variants were incubated at either room temperature (25° C.) or 37° C. for 1 or 3 days prior to determination of protease activity as described herein.

HTP Evaluation of Multiple Challenges in Sequence

When two stability characteristics were simultaneously being investigated, two challenge screens were combined in series. For example, a one hour thermostability challenge was followed by a one hour pH and pepsin challenge. This is denoted as a sequential challenge or sequential preincubations. Following a sequential challenge, samples were analyzed for residual protease activity as described herein.

HTP Evaluation of Protease Activity after Pre-Incubation with Sodium Taurocholate The activities of the protease variants were determined after pre-incubation at neutral pH in the presence of sodium taurocholate to simulate the environment of the intestines. Clarified lysate was mixed 1:1 with 100 mM NaPO$_4$, pH 6.5, containing 10 mM sodium taurocholate, for a final pH of 6.5 and a final concentration of 5 mM sodium taurocholate, in a PCR plate (BioRad). The mixture was incubated for 1 hr at 37° C. in a thermocycler. Samples were diluted an additional 8× in 100 mM NaPO$_4$, pH 6.5, before being analyzed for residual protease activity as described herein.

Shake Flask Expression and Purification of Protease Variants

A single colony of E. coli containing a plasmid encoding an engineered polypeptide of interest was inoculated into 5 mL Luria Bertani media with 1% glucose and selection. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7, 1 mM MgSO4) with selection, in a 1 liter flask and allowed to grow at 30° C. Expression of the amylase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 min, 4° C.) and the supernatant discarded. The cells were resuspended in 40-50 mL of PBS with 150 mM NaCl, and passed through a MICROFLUDIZER® high pressure homogenizer (Microfluidics) with standard E. coli lysis settings and maintained at 4° C. The cleared lysate supernatant was collected, and imidazole was added to the lysate for a final concentration of 25 mM. This lysate was HIS-affinity purified on the AKTA Start system with the AC Step 1 ml/5 ml HiTrap—Affinity Chromatography Quick Start protocol using PBS with 150 mL NaCl and 25 mM imidazole as the wash buffer, and PBS with 150 mL NaCl and 250 mM imidazole as the elution buffer. The purified protease was buffered exchanged into PBS with EconoPac-10DG Desalting Prepacked Gravity Flow Columns from Biorad.

Example 3: Screening Results for Protease Variants

The variants generated from homolog diversity and saturation mutagenesis were screened in singlicate for protease activity at pH 7.8, and after a pre-incubation at pH 4 for 1 hr as described in Example 2. Results (relative to the results obtained with SEQ ID NO: 2) are provided in Table 3.1. Some variants generated from the homolog diversity and saturation mutagenesis libraries were assayed in triplicate for protease activity at pH 7.8, and after a pre-incubation at pH 4 for 1 hr, as described in Example 2. Results (relative to the results obtained with SEQ ID NO: 2) are provided in Table 3.2.

TABLE 3.1

Protease Activity Relative to SEQ ID NO: 2[1]

| SEQ ID NO: (nt/aa) | Amino Acid Differences (Relative to SEQ ID NO: 2) | Unchallenged Activity Improvement (Relative to SEQ ID NO: 2) | pH 4 Pre-Incubation Improvement (Relative to SEQ ID NO: 2) |
|---|---|---|---|
| 3/4 | P446L | | +++ |
| 5/6 | P446A | ++ | +++ |
| 7/8 | P446T | ++ | ++ |
| 9/10 | P446M | ++ | ++ |
| 11/12 | P446G | | + |
| 13/14 | P427L | ++ | ++ |
| 15/16 | N448M | ++ | + |
| 17/18 | Q363Y | ++ | + |
| 19/20 | N339M | ++ | + |

[1]All activities were determined relative to the reference polypeptide of SEQ ID NO: 2. Levels of increased activity are defined as follows: "+" = 0.9 to 1.1; "++" > 1.1; "+++" > 1.5; and "++++" > 3.

TABLE 3.2

Protease Activity Relative to SEQ ID NO: 2[1]

| SEQ ID NO: (nt/aa) | Amino Acid Differences (Relative to SEQ ID NO: 2) | Unchallenged Activity Improvement (Relative to SEQ ID NO: 2) | pH 4 Pre-Incubation Improvement (Relative to SEQ ID NO: 2) |
|---|---|---|---|
| 21/22 | P427R | +++ | +++ |
| 23/24 | E261S | +++ | +++ |
| 25/26 | E261R | +++ | +++ |
| 27/28 | N448R | +++ | +++ |
| 29/30 | E261V | +++ | +++ |
| 31/32 | A449K | +++ | ++ |
| 33/34 | P446R | +++ | +++ |
| 35/36 | E261L | +++ | +++ |
| 37/38 | E261G/Q504V | +++ | +++ |
| 39/40 | N448K | +++ | +++ |
| 41/42 | T162I/A408R | +++ | ++ |
| 43/44 | L342R | +++ | ++ |
| 45/46 | A408R | +++ | +++ |
| 47/48 | N223R/E241P/Q258K/D599L | +++ | +++ |
| 49/50 | Q258K/A481S | +++ | ++ |
| 51/52 | P446V | +++ | +++ |
| 53/54 | E261G | +++ | +++ |
| 55/56 | T544R | +++ | +++ |
| 57/58 | S168N/Q547V | +++ | ++ |
| 59/60 | Q258K | +++ | ++ |
| 61/62 | N210D/N223R/Q258K/K552N | +++ | ++ |
| 63/64 | Q258R | +++ | ++ |
| 65/66 | N450W | +++ | ++ |
| 67/68 | N210D/E241P/Q258K/D599L | +++ | +++ |
| 69/70 | R482V | ++ | +++ |
| 71/72 | N223R/A481S/M533K/K552N | ++ | +++ |
| 73/74 | N448W | ++ | ++ |
| 75/76 | N366A | ++ | +++ |
| 77/78 | M533K | ++ | ++ |
| 79/80 | N366G/R526L/K591L | ++ | ++ |
| 81/82 | N366L | ++ | +++ |
| 83/84 | K615W | ++ | ++ |
| 85/86 | A481S/M533K/K552N | ++ | +++ |
| 87/88 | P427H | ++ | ++ |
| 89/90 | Q258K/A449V/A481S | ++ | ++ |
| 91/92 | N339W | ++ | ++ |
| 93/94 | M533A | ++ | ++ |
| 95/96 | N565C | ++ | ++ |
| 97/98 | Q536V | ++ | ++ |
| 99/100 | N565D | ++ | ++ |
| 101/102 | Q345W | ++ | + |

TABLE 3.2-continued

Protease Activity Relative to SEQ ID NO: 2[1]

| SEQ ID NO: (nt/aa) | Amino Acid Differences (Relative to SEQ ID NO: 2) | Unchallenged Activity Improvement (Relative to SEQ ID NO: 2) | pH 4 Pre-Incubation Improvement (Relative to SEQ ID NO: 2) |
|---|---|---|---|
| 103/104 | N339F | ++ | ++ |
| 105/106 | N366G | ++ | +++ |
| 107/108 | T225K | ++ | ++ |
| 109/110 | N366G/Q497R | ++ | +++ |
| 111/112 | A208T/N366G/Q504P/K591L | ++ | +++ |
| 113/114 | M533K/K552N | ++ | ++ |
| 115/116 | Q536G | ++ | ++ |
| 117/118 | N366G/N485D | ++ | +++ |
| 119/120 | T225A/N362T/N366G/K591L | ++ | +++ |
| 121/122 | K615P | ++ | ++ |
| 123/124 | M533N | ++ | ++ |
| 125/126 | K652I | ++ | ++ |
| 127/128 | T225A/N366G | ++ | +++ |
| 129/130 | N366Q | ++ | ++ |
| 131/132 | V549T | ++ | ++ |
| 133/134 | R482V/K591L | ++ | +++ |
| 135/136 | Q318D/M533K | ++ | ++ |
| 137/138 | K615G | ++ | ++ |
| 139/140 | K615T | ++ | ++ |
| 141/142 | M533E | ++ | +++ |
| 143/144 | N366G/K591L | + | ++ |
| 145/146 | Q318D/D599L | + | ++ |
| 147/148 | T225A/N260D/R263H/G265R/T544R | + | +++ |
| 149/150 | N362T/N366G/N485D/K591L | + | +++ |
| 151/152 | T225A/P262L | + | +++ |
| 153/154 | Q547E | + | ++ |
| 155/156 | Q363E | + | +++ |
| 157/158 | K615A | + | +++ |
| 159/160 | Q318D/A481S | + | ++ |
| 161/162 | Q258K/Q318D/K429L | + | ++ |
| 163/164 | Q363W | + | ++ |
| 165/166 | Q547A | + | ++ |
| 167/168 | N485D | + | ++ |
| 169/170 | A208T/N485D/R526L | + | ++ |
| 171/172 | Q536E | + | +++ |
| 173/174 | R482V/N485D | + | ++ |
| 175/176 | R244K | + | ++ |
| 177/178 | T225A/R482V/K591L | + | +++ |
| 179/180 | M107T/Q536D | + | ++ |
| 181/182 | N223R/K429L/A481S/M533K | + | ++ |
| 183/184 | K615D | + | +++ |
| 185/186 | M533D | | +++ |
| 187/188 | N485D/K591L | | ++ |

[1]All activities were determined relative to the reference polypeptide of SEQ ID NO: 2. Levels of increased activity are defined as follows: "+" = 0.9 to 1.1; "++" > 1.1; "+++" > 1.5; and "++++" > 3.

Based on the results shown in Table 3.2, SEQ ID NO: 34 was chosen as the next parent sequence for the next iteration of protein optimization. Beneficial mutations identified from the results shown in Table 3.2, were recombined into the backbone. The variants were screened in triplicate for protease activity at pH 7.8, and after a pre-incubation at pH 3, for 1 hr, as described in Example 2. The results (relative to those obtained for SEQ ID NO: 34) are provided in Table 3.3.

TABLE 3.3

Protease Activity Relative to SEQ ID NO: 34[1]

| SEQ ID NO: (nt/aa) | Amino Acid Differences (Relative to SEQ ID NO: 34) | Amino Acid Differences (Relative to SEQ ID NO: 2) | Unchallenged Activity Improvement (Relative to SEQ ID NO: 34) | pH 3 Pre-Incubation Improvement (Relative to SEQ ID NO: 34) |
|---|---|---|---|---|
| 189/190 | Q258K/L342R | Q258K/L342R/P446R | ++++ | + |
| 191/192 | L342R/A408R | L342R/A408R/P446R | ++++ | + |
| 193/194 | L342R | L342R/P446R | ++++ | + |
| 195/196 | Q258K/P427R | Q258K/P427R/P446R | +++ | + |
| 197/198 | N362T/N448R | N362T/P446R/N448R | +++ | + |
| 199/200 | N448R | P446R/N448R | +++ | + |
| 201/202 | N339W/N448K | N339W/P446R/N448K | +++ | + |
| 203/204 | N339W/N448R | N339W/P446R/N448R | +++ | + |
| 205/206 | N448R/T544R | P446R/N448R/T544R | +++ | + |
| 207/208 | Q258K | Q258K/P446R | +++ | + |
| 209/210 | Q258K/A408R/P427R/Q504P/V549T | Q258K/A408R/P427R/P446R/Q504P/V549T | +++ | + |
| 211/212 | Q258K/L342R/Q504P/M533K/Q536E/V549T | Q258K/L342R/P446R/Q504P/M533K/Q536E/V549T | +++ | + |
| 213/214 | N339W/N448R/Q547E | N339W/P446R/N448R/Q547E | +++ | + |
| 215/216 | L342R/A408R/Q536E | L342R/A408R/P446R/Q536E | +++ | + |
| 217/218 | E261L/L342R/Q345W/Q536E | E261L/L342R/Q345W/P446R/Q536E | +++ | + |

TABLE 3.3-continued

Protease Activity Relative to SEQ ID NO: 34[1]

| SEQ ID NO: (nt/aa) | Amino Acid Differences (Relative to SEQ ID NO: 34) | Amino Acid Differences (Relative to SEQ ID NO: 2) | Unchallenged Activity Improvement (Relative to SEQ ID NO: 34) | pH 3 Pre-Incubation Improvement (Relative to SEQ ID NO: 34) |
|---|---|---|---|---|
| 219/220 | Q258K/P427R/R482V/Q536E | Q258K/P427R/P446R/R482V/Q536E | +++ | ++ |
| 221/222 | L342R/R482V/Q536E | L342R/P446R/R482V/Q536E | +++ | + |
| 223/224 | Q258K/E261L/L342R/Q504P/M533D | Q258K/E261L/L342R/P446R/Q504P/M533D | +++ | ++ |
| 225/226 | E261R/R482V | E261R/P446R/R482V | +++ | +++ |
| 227/228 | Q258K/E261L/Q345W/Q504P/V549T | Q258K/E261L/Q345W/P446R/Q504P/V549T | +++ | + |
| 229/230 | P427R/M533K/Q536E/V549T | P427R/P446R/M533K/Q536E/V549T | +++ | + |
| 231/232 | E261L/L342R/R482V/Q504P/M533K/Q536E | E261L/L342R/P446R/R482V/Q504P/M533K/Q536E | +++ | + |
| 233/234 | E261R/L342R/R482V/Q536E | E261R/L342R/P446R/R482V/Q536E | +++ | ++ |
| 235/236 | Q258K/E261L/L342R/Q345W | Q258K/E261L/L342R/Q345W/P446R | +++ | + |
| 237/238 | Q258K/P427R/R482V/Q504P/M533K/Q536E | Q258K/P427R/P446R/R482V/Q504P/M533K/Q536E | +++ | + |
| 239/240 | Q258K/Q345W/P427R | Q258K/Q345W/P427R/P446R | +++ | + |
| 241/242 | N448R/T544R/Q547E/K615A | P446R/N448R/T544R/Q547E/K615A | ++ | + |
| 243/244 | Q318D/N448R/T544R/K615A | Q318D/P446R/N448R/T544R/K615A | ++ | + |
| 245/246 | E261L/L342R/M533D | E261L/L342R/P446R/M533D | ++ | ++ |
| 247/248 | P427R/R482V/Q504P/M533D/Q536E | P427R/P446R/R482V/Q504P/M533D/Q536E | ++ | + |
| 249/250 | Q363E/T544R/Q547E | Q363E/P446R/T544R/Q547E | ++ | ++ |
| 251/252 | N339W/N362T/T544R | N339W/N362T/P446R/T544R | ++ | ++ |
| 253/254 | N339W/N362T/Q363E/T544R/Q547E/K615A | N339W/N362T/Q363E/P446R/T544R/Q547E/K615A | ++ | +++ |
| 255/256 | E261R/L342R/R482V/Q504P/V549T | E261R/L342R/P446R/R482V/Q504P/V549T | ++ | ++ |
| 257/258 | Q318D/N339W/Q547E | Q318D/N339W/P446R/Q547E | ++ | ++ |
| 259/260 | N362T/Q363E/T544R/Q547E | N362T/Q363E/P446R/T544R/Q547E | ++ | ++ |
| 261/262 | Q258K/E261R/R482V/Q504P/V549T | Q258K/E261R/P446R/R482V/Q504P/V549T | ++ | +++ |
| 263/264 | Q318D/N339W/N362T/T544R/Q547E | Q318D/N339W/N362T/P446R/T544R/Q547E | + | +++ |
| 265/266 | Q318D/N339W/N448R/T544R | Q318D/N339W/P446R/N448R/T544R | + | ++ |
| 267/268 | N339W/T544R/Q547E | N339W/P446R/T544R/Q547E | | ++ |

[1] All activities were determined relative to the reference polypeptide of SEQ ID NO: 34. Levels of increased activity are defined as follows: "+" = 0.9 to 1.1; "++" > 1.1; "+++" > 1.5; and "++++" > 3.

Based on the results shown in Table 3.3, SEQ ID NO: 190 was chosen as the next parent sequence for the next iteration of protein optimization. Beneficial mutations identified from the results shown in Table 3.3, were recombined into the backbone. Additionally, variants were also constructed, based on SEQ ID NO: 190, with mutagenesis at different positions. The variants were assayed in singlicate for protease activity at pH 7.8, and after a pre-incubation at pH 3.5 for 1 hr as described in Example 2. The results (relative to those obtained for SEQ ID NO: 190) are provided in Table 3.4. In addition, some of the variants from the libraries were assayed in triplicate for protease activity at pH 7.8, and after a pre-incubation at pH 3.5 for 1 hr, as described in Example 2. The results (relative to those obtained for SEQ ID NO: 190) are provided in Table 3.5.

TABLE 3.4

Protease Activity Relative to SEQ ID NO: 190[1]

| SEQ ID NO: (nt/aa) | Amino Acid Differences (Relative to SEQ ID NO: 190) | Amino Acid Differences (Relative to SEQ ID NO: 2) | Unchallenged Activity Improvement (Relative to SEQ ID NO: 190) | pH 3.5 Pre-Incubation Improvement (Relative to SEQ ID NO: 190) |
|---|---|---|---|---|
| 269/270 | A646L | Q258K/L342R/P446R/A646L | | ++++ |
| 271/272 | A646V | Q258K/L342R/P446R/A646V | | ++ |
| 273/274 | Q505A | Q258K/L342R/P446R/Q505A | | +++ |
| 275/276 | S205Q | S205Q/Q258K/L342R/P446R | | +++ |
| 277/278 | S205T | S205T/Q258K/L342R/P446R | + | ++ |
| 279/280 | S541R | Q258K/L342R/P446R/S541R | | +++ |
| 281/282 | T556V | Q258K/L342R/P446R/T556V | | ++++ |

[1]All activities were determined relative to the reference polypeptide of SEQ ID NO: 190. Levels of increased activity are defined as follows: "+" = 0.9 to 1.1; "++" > 1.1; "+++" > 1.5; and "++++" > 3.

TABLE 3.5

Protease Activity Relative to SEQ ID NO: 190[1]

| SEQ ID NO: (nt/aa) | Amino Acid Differences (Relative to SEQ ID NO: 190) | Amino Acid Differences (Relative to SEQ ID NO: 2) | Unchallenged Activity Improvement (Relative to SEQ ID NO: 190) | pH 3.5 Pre-Incubation Improvement (Relative to SEQ ID NO: 190) |
|---|---|---|---|---|
| 283/284 | E261L | E261L/Q258K/L342R/P446R | ++ | ++ |
| 285/286 | E261L/N339S/Q547E | Q258K/E261L/N339S/L342R/P446R/Q547E | ++ | +++ |
| 287/288 | S205R | S205R/Q258K/L342R/P446R | ++ | +++ |
| 289/290 | V442S | Q258K/L342R/V442S/P446R | ++ | ++ |
| 291/292 | E261L/N339W | Q258K/E261L/N339W/L342R/P446R | ++ | ++++ |
| 293/294 | E663* | Q258K/L342R/P446R/E663* | ++ | +++ |
| 295/296 | D239K | D239K/Q258K/L342R/P446R | ++ | ++ |
| 297/298 | E261L/Q536W | Q258K/E261L/L342R/P446R/Q536W | ++ | +++ |
| 299/300 | V594A | Q258K/L342R/P446R/V594A | ++ | +++ |
| 301/302 | P665E | Q258K/L342R/P446R/P665E | ++ | ++ |
| 303/304 | V405R | Q258K/L342R/V405R/P446R | ++ | ++ |
| 305/306 | S220A | S220A/Q258K/L342R/P446R | ++ | ++ |
| 307/308 | V442L | Q258K/L342R/V442L/P446R | ++ | ++ |
| 309/310 | T558E | Q258K/L342R/P446R/T558E | ++ | +++ |
| 311/312 | N339W/P427R/Q547E | Q258K/N339W/L342R/P427R/P446R/Q547E | ++ | +++ |
| 313/314 | E261L/Q536W/Q547E | Q258K/E261L/L342R/P446R/Q536W/Q547E | + | +++ |
| 315/316 | Q505G | Q258K/L342R/P446R/Q505G | + | +++ |
| 317/318 | N339W/P427R/Q536W/Q547E | Q258K/N339W/L342R/P427R/P446R/Q536W/Q547E | + | +++ |
| 319/320 | E663M | Q258K/L342R/P446R/E663M | + | ++ |
| 321/322 | A545R | Q258K/L342R/P446R/A545R | + | ++++ |
| 323/324 | A545I | Q258K/L342R/P446R/A545I | + | ++++ |
| 325/326 | N339W/P427R/Q536W | Q258K/N339W/L342R/P427R/P446R/Q536W | + | ++ |
| 327/328 | S541G | Q258K/L342R/P446R/S541G | + | +++ |
| 329/330 | S541I | Q258K/L342R/P446R/S541I | | ++++ |
| 331/332 | I542* | Q258K/L342R/P446R/I542* | | +++ |
| 333/334 | G631W | Q258K/L342R/P446R/G631W | | ++ |
| 335/336 | A545* | Q258K/L342R/P446R/A545* | | +++ |
| 337/338 | P539* | Q258K/L342R/P446R/P539* | | +++ |
| 339/340 | T556* | Q258K/L342R/P446R/T556* | | ++++ |

[1]All activities were determined relative to the reference polypeptide of SEQ ID NO: 190. Levels of increased activity are defined as follows: "+" = 0.9 to 1.1; "++" > 1.1; "+++" > 1.5; and "++++" > 3.
In this Table, the asterisk (*) indicates the presence of a stop codon. Thus, SEQ ID NOS: 294, 332, 334, 336, 338, and 340 are truncated, as compared to the full-length sequence of SEQ ID NO: 190.

Based on the results shown in Table 3.5, SEQ ID NO: 292 was chosen as the next parent sequence for the next iteration of protein optimization. Beneficial mutations identified based on the results shown in Table 3.5 were recombined into the backbone. Additionally, variants were also constructed based on SEQ ID: 292, with mutagenesis at different positions. The variants were assayed in triplicate for protease activity at pH 6.5, after a pre-incubation with 5 mM taurocholate for 1 hr, and after a pre-incubation at pH 4, with 0.5 mg/mL pepsin for 1 hr as described in Example 2. The results (relative to those obtained for SEQ ID NO: 292) are provided in Table 3.6.

TABLE 3.6

| | | | | |
|---|---|---|---|---|
| | | | Taurocholate | Pepsin Pre- |
| | Amino Acid | Amino Acid | Pre-Incubation | Incubation |
| | Differences | Differences | Improvement | Improvement |
| SEQ ID | (Relative to | (Relative to | (Relative to | (Relative to |
| NO: | SEQ ID NO: | SEQ ID NO: | SEQ ID NO: | SEQ ID NO: |
| (nt/aa) | 292) | 2) | 292) | 292) |
| 341/342 | S205R/V442L/Q505A/Q536W/A545I/E620V/A646V | S205R/Q258K/E261L/N339W/L342R/V442L/P446R/Q505A/Q536W/A545I/E620V/A646V | ++ | +++ |
| 343/344 | G506R | Q258K/E261L/N339W/L342R/P446R/G506R | ++ | ++ |
| 345/346 | E620L | Q258K/E261L/N339W/L342R/P446R/E620L | ++ | |
| 347/348 | E620Q | Q258K/E261L/N339W/L342R/P446R/E620Q | ++ | ++ |
| 349/350 | I650T | Q258K/E261L/N339W/L342R/P446R/I650T | + | + |
| 351/352 | F359Y | Q258K/E261L/N339W/L342R/F359Y/P446R | + | + |
| 353/354 | E555D | Q258K/E261L/N339W/L342R/P446R/E555D | + | ++ |
| 355/356 | A449L | Q258K/E261L/N339W/L342R/P446R/A449L | + | + |
| 357/358 | E620S | Q258K/E261L/N339W/L342R/P446R/E620S | + | ++ |
| 359/360 | E555G | Q258K/E261L/N339W/L342R/P446R/E555G | + | + |
| 361/362 | Q505A/Q536W/A545I/T558E/A646V | Q258K/E261L/N339W/L342R/P446R/Q505A/Q536W/A545I/T558E/A646V | + | +++ |
| 363/364 | E555L | Q258K/E261L/N339W/L342R/P446R/E555L | + | + |
| 365/366 | T556G | Q258K/E261L/N339W/L342R/P446R/T556G | + | ++ |
| 367/368 | K258G | K258G/E261L/N339W/L342R/P446R | + | |
| 369/370 | S205R/Q505A/Q536W/S541I/A545R/Q547E/T558E/A646V/P665E | S205R/Q258K/E261L/N339W/L342R/P446R/Q505A/Q536W/S541I/A545R/Q547E/T558E/A646V/P665E | | ++ |
| 371/372 | L355R/Q536W/A545I/Q547E | Q258K/E261L/N339W/L342R/L355R/P446R/Q536W/A545I/Q547E | | +++ |
| 373/374 | N366S | Q258K/E261L/N339W/L342R/N366S/P446R | | ++ |
| 375/376 | R263M | Q258K/E261L/N339W/L342R/P446R | | + |
| 377/378 | R263S | Q258K/E261L/R263M/N339W/L342R/P446R | | ++ |
| 379/380 | R446P | Q258K/E261L/N339W/L342R | | + |

[1]All activities were determined relative to the reference polypeptide of SEQ ID NO: 292. Levels of increased activity are defined as follows: "+" = 0.9 to 1.1; "++" > 1.1; "+++" > 1.5; and "++++" > 3.

Based on the results shown in Table 3.6, SEQ ID NO: 342 was chosen as the next parent sequence for the next iteration of protein optimization. Beneficial mutations identified based on the results shown in Table 3.6 were recombined into the backbone. The variants were assayed in triplicate for protease activity at pH 6.5, after a pre-incubation with 5 mM taurocholate for 1 hr, and after a pre-incubation at pH 4, with 0.5 mg/mL pepsin for 1 hr as described in Example 2. The results (relative to those obtained for SEQ ID NO: 342), are provided in Table 3.7.

TABLE 3.7

Protease Activity Relative to SEQ ID NO: 342[1]

| SEQ ID NO: (nt/aa) | Amino Acid Differences (Relative to SEQ ID NO: 342) | Amino Acid Differences (Relative to SEQ ID NO: 2) | Taurocholate Pre-Incubation Improvement (Relative to SEQ ID NO: 342) | Pepsin Pre-Incubation Improvement (Relative to SEQ ID NO: 342) |
|---|---|---|---|---|
| 381/382 | A449L/N450R | S205R/Q258K/E261L/N339W/L342R/V442L/P446R/A449L//N450R/Q505A/Q536W/A545I/E620V/A646V | ++ | +++ |
| 383/384 | N283H/Q345C/F359Y/A449L/N450R/D553T/E555G | S205R/Q258K/E261L/N283H/N339W/L342R/Q345C/F359Y/V442L/P446R/A449L/N450R/Q505A/Q536W/A545I/D553T/E555G/E620V/A646V | | ++ |
| 385/386 | N508G/S541I/D553T | S205R/Q258K/E261L/N339W/L342R/V442L/P446R/Q505A/N508G/Q536W/D553T/S541I/A545I/E620V/A646V | | ++ |
| 387/388 | N283L/A449L/N450R/N508G/S541I/D553T/E555G | S205R/Q258K/E261L/N283L/N339W/L342R/V442L/P446R/A449L/N450R/Q505A/N508G/Q536W/S541I/A545I/D553T/E555GE620V/A646V | | ++ |
| 389/390 | N283L/N319K/F359Y/A449L/N450R/G506R | S205R/Q258K/E261L/N283L/N319K/N339W/L342R/F359Y/V442L/P446R/A449L/N450R/Q505A/G506RQ536W/A545I/E620V/A646V | | ++ |
| 391/392 | N508G | S205R/Q258K/E261L/N339W/L342R/V442L/P446R/Q505A/N508G/Q536W/A545I/E620V/A646V | ++ | ++ |
| 393/394 | N450R/N508G/D553R/E555G/T558E | S205R/Q258K/E261L/N339W/L342R/V442L/P446R/N450R/Q505A/N508G/Q536W/A545I/D553R/E555G/T558E/E620V/A646V | | + |

[1]All activities were determined relative to the reference polypeptide of SEQ ID NO: 342. Levels of increased activity are defined as follows: "+" 0.9 to 1.1; "++" > 1.1; "+++" > 1.5; and "++++" > 3.

Based on the results shown in Table 3.7, SEQ ID NO: 382 was chosen as the next parent sequence for the next iteration of protein optimization. This sequence was subcloned into the pJV110900 vector with a C-terminal histidine tag (SEQ ID NO: 396). Beneficial mutations identified based on the results shown in Table 3.7 were recombined using SEQ ID NO: 396. Additionally, variants were constructed using SEQ ID NO: 396, through homolog diversity and mutagenesis at different positions. The variants were assayed in triplicate for protease activity at pH 6.5, after pre-incubation for 1 hr at 42° C., and after a pre-incubation at pH 3.8, with 1.5 mg/mL pepsin for 2 hrs as described in Example 2. The results (relative to those obtained for SEQ ID NO: 396) are provided in Table 3.8.

TABLE 3.8

| | | | Temperature | Pepsin Pre- |
| | | | Pre-Incubation | Incubation |
| | Amino Acid | Amino Acid | Improvement | Improvement |
| SEQ ID | Differences | Differences | (Relative to | (Relative to |
| NO: | (Relative to | (Relative to | SEQ ID NO: | SEQ ID NO: |
| (nt/aa) | SEQ ID NO: 396)[2] | SEQ ID NO: 2)[3] | 396) | 396) |
|---|---|---|---|---|
| | Protease Activity Relative to SEQ ID NO: 396[1] | | | |
| 395/396 | | S205R/Q258K/E261L/N339W/ L342R/V442L/P446R/A449L/ N450R/Q505A/Q536W/A545I/ E620V/A646V | + | + |
| 397/398 | K258Q/L442V/ L449A/V646A | S205R/E261L/N339W/L342R/ P446R/N450R/Q505A/Q536W/ A545I/E620V | + | |
| 399/400 | S439M | S205R/Q258K/E261L/N339W/ L342R/S439M/V442L/P446R/ A449L/N450R/Q505A/Q536W/ A545I/E620V/A646V | | +++ |
| 401/402 | R514H | S205R/Q258K/E261L/N339W/ L342R/V442L/P446R/A449L/ N450R/Q505A/R514H/Q536W/ A545I/E620V/A646V | ++ | +++ |
| 403/404 | L442V/R446P/ W536Q/I545A/ V620E/V646A | S205R/Q258K/E261L/N339W/ L342R/A449L/N450R/Q505A | | +++ |
| 405/406 | K258Q/L442V/ R446P | S205R/E261L/N339W/L342R/ A449L/N450R/Q505A/Q536W/ A545I/E620V/A646V | | ++ |
| 407/408 | D644A | S205R/Q258K/E261L/N339W/ L342R/V442L/P446R/A449L/ N450R/Q505A/Q536W/A545I/ E620V/D644A/A646V | ++ | ++ |
| 409/410 | A308E | S205R/Q258K/E261L/A308E/ N339W/L342R/V442L/P446R/ A449L/N450R/Q505A/Q536W/ A545I/E620V/A646V | + | ++ |
| 411/412 | E535R | S205R/Q258K/E261L/N339W/ L342R/V442L/P446R/A449L/ N450R/Q505A/E535R/Q536W/ A545I/E620V/A646V | ++ | ++ |
| 413/414 | E535V | S205R/Q258K/E261L/N339W/ L342R/V442L/P446R/A449L/ N450R/Q505A/E535V/Q536W/ A545I/E620V/A646V | + | ++ |
| 415/416 | D577V | S205R/Q258K/E261L/N339W/ L342R/V442L/P446R/A449L/ N450R/Q505A/Q536W/A545I/ D577V/E620V/A646V | | ++ |
| 417/418 | K591V | S205R/Q258K/E261L/N339W/ L342R/V442L/P446R/A449L/ N450R/Q505A/Q536W/A545I/ K591V/E620V/A646V | ++ | ++ |
| 419/420 | A639K | S205R/Q258K/E261L/N339W/ L342R/V442L/P446R/A449L/ N450R/Q505A/Q536W/A545I/ E620V/A639K/A646V | | ++ |
| 421/422 | A643R | S205R/Q258K/E261L/N339W/ L342R/V442L/P446R/A449L/ N450R/Q505A/Q536W/A545I/ E620V/A643R/A646V | + | ++ |
| 423/424 | A610P | S205R/Q258K/E261L/N339W/ L342R/V442L/P446R/A449L/ N450R/Q505A/Q536W/A545I/ A610P/E620V/A646V | ++ | ++ |
| 425/426 | I361V | S205R/Q258K/E261L/N339W/ L342R/I361V/V442L/P446R/ A449L/N450R/Q505A/Q536W/ A545I/E620V/A646V | | ++ |
| 427/428 | K591R | S205R/Q258K/E261L/N339W/ L342R/V442L/P446R/A449L/ N450R/Q505A/Q536W/A545I/ K591R/E620V/A646V | + | ++ |
| 429/430 | A610S | S205R/Q258K/E261L/N339W/ L342R/V442L/P446R/A449L/ N450R/Q505A/Q536W/A545I/ A610S/E620V/A646V | ++ | + |

TABLE 3.8-continued

Protease Activity Relative to SEQ ID NO: 396[1]

| SEQ ID NO: (nt/aa) | Amino Acid Differences (Relative to SEQ ID NO: 396)[2] | Amino Acid Differences (Relative to SEQ ID NO: 2)[3] | Temperature Pre-Incubation Improvement (Relative to SEQ ID NO: 396) | Pepsin Pre-Incubation Improvement (Relative to SEQ ID NO: 396) |
|---|---|---|---|---|
| 431/432 | A610L | S205R/Q258K/E261L/N339W/L342R/V442L/P446R/A449L/N450R/Q505A/Q536W/A545I/A610L/E620V/A646V | ++ | + |
| 433/434 | A592P | S205R/Q258K/E261L/N339W/L342R/V442L/P446R/A449L/N450R/Q505A/A592P/Q536W/A545I/E620V/A646V | + | + |
| 435/436 | A643E | S205R/Q258K/E261L/N339W/L342R/V442L/P446R/A449L/N450R/Q505A/Q536W/A545I/E620V/A643E/A646V | + | + |
| 437/438 | A639E | S205R/Q258K/E261L/N339W/L342R/V442L/P446R/A449L/N450R/Q505A/Q536W/A545I/E620V/A639E/A646V | + | + |
| 439/440 | R205S | Q258K/E261L/N339W/L342R/V442L/P446R/A449L/N450R/Q505A/Q536W/A545I/E620V/A646V | + | |
| 441/442 | K258Q/R450N/W536Q/I545A | S205R/E261L/N339W/L342R/V442L/P446R/A449L/Q505A/E620V/A646V | ++ | |
| 443/444 | R205S/L442V/L449A/R450N | Q258K/E261L/N339W/L342R/P446R/Q505A/Q536W/A545I/E620V/A646V | ++ | |
| 445/446 | L442V/R450N/W536Q/I545A | S205R/Q258K/E261L/N339W/L342R/P446R/A449L/Q505A/E620V/A646V | ++ | |
| 447/448 | R205S/R450N/W536Q/I545A | Q258K/E261L/N339W/L342R/V442L/P446R/A449L/Q505A/E620V/A646V | ++ | |
| 449/450 | R205S/R450N/W536Q/I545A/V646A | Q258K/E261L/N339W/L342R/V442L/P446R/A449L/Q505A/E620V | ++ | |

[1]All activities were determined relative to the reference polypeptide of SEQ ID NO: 396. Levels of increased activity are defined as follows: "+" = 0.9 to 1.1; "++" > 1.1; "+++" > 1.5; and "++++" > 3.
[2]SEQ ID NO: 382 with C-terminal Histidine tag
[3]Amino Acid Differences does not include Histidine tag at C-terminus Based on the results shown in Table 3.8, SEQ ID NO: 400 was chosen as the next parent sequence for the next iteration of protein optimization. Beneficial mutations identified based on the results shown in Table 3.8 were recombined into the backbone. Additionally, variants were also constructed using SEQ ID NO: 400, through homolog diversity at different positions. The variants were assayed in triplicate for protease activity at pH 6, in a sequential screen comprising of a pre-incubation for 1 hr at 48° C., followed by a pre-incubation at pH 3.8, with 1.5 mg/mL pepsin for 1 hr as described in Example 2. The results (relative to those obtained for SEQ ID NO: 400) are provided in Table 3.9.

TABLE 3.9

Protease Activity Relative to SEQ ID NO: 400[1]

| SEQ ID NO: (nt/aa) | Amino Acid Differences (Relative to SEQ ID NO: 400) | Amino Acid Differences (Relative to SEQ ID NO: 2)[2] | Sequential Pre-Incubation Improvement (Relative to SEQ ID NO: 400) |
|---|---|---|---|
| 451/452 | A308E/R514H/E535R/A639K/D644A | S205R/Q258K/E261L/A308E/N339W/L342R/S439M/V442L/P446R/A449L/N450R/Q505A/R514H/E535R/Q536W/A545I/E620V/A639K/D644A/A646V | +++ |
| 453/454 | A408V/R514H/E537P | S205R/Q258K/E261L/N339W/L342R/A408V/S439M/V442L/P446R/A449L/N450R/Q505A/R514H/Q536W/E537P/A545I/E620V/A646V | ++++ |
| 455/456 | A408V/R514H/T560S/I650T | S205R/Q258K/E261L/N339W/L342R/A408V/S439M/V442L/P446R/A449L/N450R/Q505A/R514H/Q536W/A545I/T560S/E620V/A646V/I650T | ++++ |

TABLE 3.9-continued

Protease Activity Relative to SEQ ID NO: 400[1]

| SEQ ID NO: (nt/aa) | Amino Acid Differences (Relative to SEQ ID NO: 400) | Amino Acid Differences (Relative to SEQ ID NO: 2)[2] | Sequential Pre-Incubation Improvement (Relative to SEQ ID NO: 400) |
|---|---|---|---|
| 457/458 | A408V/S512N | S205R/Q258K/E261L/N339W/L342R/A408V/S439M/ V442L/P446R/A449L/N450R/Q505A/S512N/Q536W/ A545I/E620V/A646V | ++++ |
| 459/460 | E535R/A639K/ A643R/D644A | S205R/Q258K/E261L/N339W/L342R/S439M/V442L/ P446R/A449L/N450R/Q505A/E535R/Q536W/A545I/ E620V/A639K/A643R/D644A/A646V | +++ |
| 461/462 | E535R/S575G/ A639K/D644A | S205R/Q258K/E261L/N339W/L342R/S439M/V442L/ P446R/A449L/N450R/Q505A/E535R/Q536W/A545I/ S575G/E620V/A639K/D644A/A646V | ++ |
| 463/464 | E535V/A643R/ D644A | S205R/Q258K/E261L/N339W/L342R/S439M/V442L/ P446R/A449L/N450R/Q505A/E535V/Q536W/A545I/ E620V/A643R/D644A/A646V | + |
| 465/466 | F359Y/S404G | S205R/Q258K/E261L/N339W/L342R/F359Y/S404G/ S439M/V442L/P446R/A449L/N450R/Q505A/Q536W/ A545I/E620V/A646V | ++ |
| 467/468 | F359Y/S404G/ K406R/Q490E/ V546E/S581T | S205R/Q258K/E261L/N339W/L342R/F359Y/S404G/ K406R/S439M/V442L/P446R/A449L/N450R/Q490E/ Q505A/S581T/Q536W/A545I/V546E/E620V/A646V | +++ |
| 469/470 | I32T/Q490E/ A639T | I32T/S205R/Q258K/E261L/N339W/L342R/S439M/ V442L/P446R/A449L/N450R/Q490E/Q505A/Q536W/ A545I/E620V/A639T/A646V | +++ |
| 471/472 | L238I/F359Y/ S370C/S404G/ Q490E/L568P/ A639T | S205R/L238I/Q258K/E261L/N339W/L342R/F359Y/ S370C/S404G/S439M/V442L/P446R/A449L/N450R/ Q490E/Q505A/Q536W/A545I/L568P/E620V/A639T/ A646V | ++ |
| 473/474 | M236V | S205R/M236V/Q258K/E261L/N339W/L342R/S439M/ V442L/P446R/A449L/N450R/Q505A/Q536W/A545I/ E620V/A646V | +++ |
| 475/476 | M236V/A592P | S205R/M236V/Q258K/E261L/N339W/L342R/S439M/ V442L/P446R/A449L/N450R/Q505A/Q536W/A545I/ A592P/E620V/A646V | +++ |
| 477/478 | M236V/A639T | S205R/M236V/Q258K/E261L/N339W/L342R/S439M/ V442L/P446R/A449L/N450R/Q505A/Q536W/A545I/ E620V/A639T/A646V | ++++ |
| 479/480 | M236V/F359Y/ A609G | S205R/M236V/Q258K/E261L/N339W/L342R/F359Y/ S439M/V442L/P446R/A449L/N450R/Q505A/Q536W/ A545I/A609G/E620V/A646V | +++ |
| 481/482 | M236V/F359Y/ E555Q | S205R/M236V/Q258K/E261L/N339W/L342R/F359Y/ S439M/V442L/P446R/A449L/N450R/Q505A/Q536W/ A545I/E555Q/E620V/A646V | +++ |
| 483/484 | M236V/F359Y/ Q490E/S581T/ A639T | S205R/M236V/Q258K/E261L/N339W/L342R/F359Y/ S439M/V442L/P446R/A449L/N450R/Q490E/Q505A/ Q536W/A545I/S581T/E620V/A639T/A646V | +++ |
| 485/486 | M236V/F359Y/ S404G/K406R/ E555Q/A639T | S205R/M236V/Q258K/E261L/N339W/L342R/F359Y/ S404G/K406R/S439M/V442L/P446R/A449L/N450R/ Q505A/Q536W/A545I/E555Q/E620V/A639T/A646V | +++ |
| 487/488 | M236V/L238I/ S404G/I480L/ E555Q/L568P/ A592P | S205R/M236V/L238I/Q258K/E261L/N339W/L342R/ S404G/S439M/V442L/P446R/A449L/N450R/I480L/ Q505A/Q536W/A545I/E555Q/L568P/A592P/E620V/ A646V | +++ |
| 489/490 | M236V/L568P | S205R/M236V/Q258K/E261L/N339W/L342R/S439M/ V442L/P446R/A449L/N450R/Q505A/Q536W/A545I/ L568P/E620V/A646V | ++++ |
| 491/492 | M236V/S370C/ K406R/L568P/ S581T | S205R/M236V/Q258K/E261L/N339W/L342R/S370C/ K406R/S439M/V442L/P446R/A449L/N450R/Q505A/ Q536W/A545I/L568P/S581T/E620V/A646V | +++ |
| 493/494 | M236V/S370C/ L568P/A592P | S205R/M236V/Q258K/E261L/N339W/L342R/S370C/ S439M/V442L/P446R/A449L/N450R/Q505A/Q536W/ A545I/L568P/A592P/E620V/A646V | +++ |
| 495/496 | M236V/S370C/ S581T | S205R/M236V/Q258K/E261L/N339W/L342R/S370C/ S439M/V442L/P446R/A449L/N450R/Q505A/Q536W/ A545I/S581T/E620V/A646V | +++ |
| 497/498 | M236V/S404G/ E555Q/S581T/ A609G/A639T | S205R/M236V/Q258K/E261L/N339W/L342R/S404G/ S439M/V442L/P446R/A449L/N450R/Q505A/Q536W/ A545I/E555Q/S581T/A609G/E620V/A639T/A646V | +++ |
| 499/500 | M236V/S404G/ K406R/I480L/ Q490E | S205R/M236V/Q258K/E261L/N339W/L342R/S404G/ K406R/S439M/V442L/P446R/A449L/I480L/ Q490E/Q505A/Q536W/A545I/E620V/A646V | +++ |
| 501/502 | M601I/I650T | S205R/Q258K/E261L/N339W/L342R/S439M/V442L/ P446R/A449L/N450R/Q505A/Q536W/A545I/M601I/ E620V/A646V/I650T | ++ |

TABLE 3.9-continued

Protease Activity Relative to SEQ ID NO: 400[1]

| SEQ ID NO: (nt/aa) | Amino Acid Differences (Relative to SEQ ID NO: 400) | Amino Acid Differences (Relative to SEQ ID NO: 2)[2] | Sequential Pre-Incubation Improvement (Relative to SEQ ID NO: 400) |
|---|---|---|---|
| 503/504 | Q363H/A639K/ D644A | S205R/Q258K/E261L/N339W/L342R/Q363H/S439M/ V442L/P446R/A449L/N450R/Q505A/Q536W/A545I/ E620V/A639K/D644A/A646V | ++ |
| 505/506 | Q363K/A408V/ M601I/I650T | S205R/Q258K/E261L/N339W/L342R/Q363K/A408V/ S439M/V442L/P446R/A449L/N450R/Q505A/Q536W/ A545I/M601I/E620V/A646V/I650T | ++++ |
| 507/508 | Q363K/A408V/ S512N/R514H/ E537P | S205R/Q258K/E261L/N339W/L342R/Q363K/A408V/ S439M/V442L/P446R/A449L/N450R/Q505A/R514H/ S512N/Q536W/E537P/A545I/E620V/A646V | ++++ |
| 509/510 | Q490E/L568P/ A592P/A639T | S205R/Q258K/E261L/N339W/L342R/S439M/V442L/ P446R/A449L/N450R/Q490E/Q505A/Q536W/A545I/ L568P/A592P/E620V/A639T/A646V | +++ |
| 511/512 | R514H/A639K/ D644A | S205R/Q258K/E261L/N339W/L342R/S439M/V442L/ P446R/A449L/N450R/Q505A/R514H/Q536W/A545I/ E620V/A639K/D644A/A646V | ++ |
| 513/514 | R514H/D644A | S205R/Q258K/E261L/N339W/L342R/S439M/V442L/ P446R/A449L/N450R/Q505A/R514H/Q536W/A545I/ E620V/D644A/A646V | ++ |
| 515/516 | R514H/E535R/ V546E/S575G/ D644A | S205R/Q258K/E261L/N339W/L342R/S439M/V442L/ P446R/A449L/N450R/Q505A/R514H/E535R/Q536W/ A545I/V546E/S575G/E620V/D644A/A646V | ++ |
| 517/518 | S512N/E537P/ T560S/M601I | S205R/Q258K/E261L/N339W/L342R/S439M/V442L/ P446R/A449L/N450R/Q505A/S512N/Q536W/E537P/ A545I/T560S/M601I/E620V/A646V | +++ |
| 519/520 | T245S/Q363K/ A408V/S512N/ R514H/M596T/ S666D | S205R/T245S/Q258K/E261L/N339W/L342R/Q363K/ A408V/S439M/V442L/P446R/A449L/N450R/Q505A/ S512N/R514H/Q536W/A545I/M596T/E620V/A646V/ S666D | ++++ |
| 521/522 | T245S/Q363K/ S512N/R514H/ E537P/T560S | S205R/T245S/Q258K/E261L/N339W/L342R/Q363K/ S439M/V442L/P446R/A449L/N450R/Q505A/S512N/ R514H/Q536W/E537P/A545I/T560S/E620V/A646V | +++ |

[1]All activities were determined relative to the reference polypeptide of SEQ ID NO: 400. Levels of increased activity are defined as follows: "+" = 0.9 to 1.1; "++" > 1.1; "+++" > 3; and "++++" > 5.
[2]Amino Acid Differences does not include Histidine tag at C-terminus Based on the results shown in Table 3.9, SEQ ID NO: 454 was chosen as the next parent sequence for the next iteration of protein optimization. Beneficial mutations identified based on the results shown in Table 3.9 were recombined into the backbone. Additionally, variants were also constructed using SEQ ID NO: 454, with mutagenesis at different positions. The variants were assayed in triplicate for protease activity at pH 6 in a sequential screen comprising pre-incubation for 1 hr at 48° C., followed by a pre-incubation at pH 3.26 with 1.5 mg/mL pepsin for 1 hr as described in Example 2. The results (relative to the results for SEQ ID NO: 454) are provided in Table 3.10.

TABLE 3.10

Protease Activity Relative to SEQ ID NO: 454[1]

| SEQ ID NO: (nt/aa) | Amino Acid Differences (Relative to SEQ ID NO: 454) | Amino Acid Differences (Relative to SEQ ID NO: 2)[2] | Sequential Pre-incubation Improvement (Relative to SEQ ID NO: 454) |
|---|---|---|---|
| 523/524 | A301V | S205R/Q258K/E261L/A301V/N339W/L342R/A408V/ S439M/V442L/P446R/A449L/N450R/Q505A/R514H/ Q536W/E537P/A545I/E620V/A646V | ++ |
| 547/548 | L300F | S205R/Q258K/E261L/L300F/N339W/L342R/A408V/ S439M/V442L/P446R/A449L/N450R/Q505A/R514H/ Q536W/E537P/A545I/E620V/A646V | ++ |
| 549/550 | M236V | S205R/M236V/Q258K/E261L/N339W/L342R/A408V/ S439M/V442L/P446R/A449L/N450R/Q505A/R514H/ Q536W/E537P/A545I/E620V/A646V | ++ |
| 551/552 | M236V/A308E/ E555Q/T560S/ M596T | S205R/M236V/Q258K/E261L/A308E/N339W/L342R/ A408V/S439M/V442L/P446R/A449L/N450R/Q505A/ R514H/Q536W/E537P/A545I/E555Q/T560S/M596T/ E620V/A646V | |

TABLE 3.10-continued

Protease Activity Relative to SEQ ID NO: 454[1]

| SEQ ID NO: (nt/aa) | Amino Acid Differences (Relative to SEQ ID NO: 454) | Amino Acid Differences (Relative to SEQ ID NO: 2)[2] | Sequential Pre-incubation Improvement (Relative to SEQ ID NO: 454) |
|---|---|---|---|
| 553/554 | M236V/A308E/ Q490E/S581T/ A643R | S205R/M236V/Q258K/E261L/A308E/N339W/L342R/ A408V/S439M/V442L/P446R/A449L/N450R/Q490E/ Q505A/R514H/Q536W/E537P/A545I/S581T/E620V/ A643R/A646V | +++ |
| 555/556 | M236V/A308E/ S370C/D548E | S205R/M236V/Q258K/E261L/A308E/N339W/L342R/ S370C/A408V/S439M/V442L/P446R/A449L/N450R/ Q505A/R514H/Q536W/E537P/A545I/D548E/E620V/ A646V | +++ |
| 557/558 | M236V/E555Q | S205R/M236V/Q258K/E261L/N339W/L342R/A408V/ S439M/V442L/P446R/A449L/N450R/Q505A/R514H/ Q536W/E537P/A545I/E555Q/E620V/A646V | ++ |
| 559/560 | M236V/S370C | S205R/M236V/Q258K/E261L/N339W/L342R/S370C/ A408V/S439M/V442L/P446R/A449L/N450R/Q505A/ R514H/Q536W/E537P/A545I/E620V/A646V | +++ |
| 561/562 | M236V/S370C/ Q490E/A639T | S205R/M236V/Q258K/E261L/N339W/L342R/S370C/ A408V/S439M/V442L/P446R/A449L/N450R/Q490E/ Q505A/R514H/Q536W/E537P/A545I/E620V/A639T/ A646V | +++ |
| 563/564 | M236V/T560S/ S581T | S205R/M236V/Q258K/E261L/N339W/L342R/A408V/ S439M/V442L/P446R/A449L/N450R/Q505A/R514H/ Q536W/E537P/A545I/T560S/S581T/E620V/A646V | ++++ |
| 565/566 | Q363K/S404G/ K406R/E535R/ L568P | S205R/Q258K/E261L/N339W/L342R/Q363K/S404G/ K406R/A408V/S439M/V442L/P446R/A449L/N450R/ Q505A/R514H/E535R/Q536W/E537P/A545I/L568P/ E620V/A646V | |
| 567/568 | S404G/K406R/ E535R | S205R/Q258K/E261L/N339W/L342R/S404G/K406R/ A408V/S439M/V442L/P446R/A449L/N450R/Q505A/ R514H/E535R/Q536W/E537P/A545I/E620V/A646V | ++ |
| 569/570 | T245S/F359Y/ Q363K/K406R/ E535R/I650T | S205R/T245S/Q258K/E261L/N339W/L342R/F359Y/ Q363K/K406R/A408V/S439M/V442L/P446R/A449L/ N450R/Q505A/R514H/E535R/Q536W/E537P/A545I/ E620V/A646V/I650T | +++ |
| 571/572 | T245S/Q363K/ K406R/S575G/ M601I/S666D | S205R/T245S/Q258K/E261L/N339W/L342R/Q363K/ A408V/S439M/K406R/V442L/P446R/A449L/N450R/ Q505A/R514H/Q536W/E537P/A545I/S575G/M601I/ E620V/A646V/S666D | |
| 573/574 | Y336W | S205R/Q258K/E261L/Y336W/N339W/L342R/A408V/ S439M/V442L/P446R/A449L/N450R/Q505A/R514H/ Q536W/E537P/A545I/E620V/A646V | ++ |

[1]All activities were determined relative to the reference polypeptide of SEQ ID NO: 454. Levels of increased activity are defined as follows: "+" = 0.9 to 1.1; "++" > 1.1; "+++" > 3; and "++++" > 5.
[2]Amino Acid Differences does not include Histidine tag at C-terminus Based on the results shown in Table 3.10, SEQ ID NO: 562 was chosen as the next parent sequence for the next iteration of protein optimization. Beneficial mutations identified based on the results shown in Table 3.10 were recombined into this backbone. Additionally, variants were also constructed using SEQ ID NO: 562, with saturation mutagenesis at different positions. The variants were purified and assayed in triplicate for protease activity at pH 6, after a pre-incubation at pH 4 with 1.5 mg/mL pepsin for 1 hr, and also for autolysis stability by measuring the protease activity after 1 day of incubation at room temperature as described in Example 2. The results (relative to the results obtained for SEQ ID NO: 562) are provided in Table 3.11. In addition, some of the variants were purified and assayed in triplicate for protease activity at pH 6, after a pre-incubation at pH 3.5 with 1.5 mg/mL pepsin for 1 hr, and also for autolysis stability by measuring the protease activity after 1 day of incubation at room temperature as described in Example 2. The results (relative to the results obtained for SEQ ID NO: 562) are provided in Table 3.12.

TABLE 3.11

Protease Activity Relative to SEQ ID NO: 562[1]

| SEQ ID NO: (nt/aa) | Amino Acid Differences (Relative to SEQ ID NO: 562) | Amino Acid Differences (Relative to SEQ ID NO: 2)[2] | Unchallenged Activity Improvement (Relative to SEQ ID NO: 562) | Autolysis Stability Improvement (Relative to SEQ ID NO: 562) | Pepsin Pre-Incubation Improvement (Relative to SEQ ID NO: 562) |
|---|---|---|---|---|---|
| 575/576 | A301V/A308E/ V346K/K406R/ A468S | S205R/M236V/Q258K/E261L/ A301V/A308E/N339W/L342R/ V346K/S370C/K406R/A408V/ | ++ | ++ | +++ |

TABLE 3.11-continued

| | | Protease Activity Relative to SEQ ID NO: 562[1] | | |
|---|---|---|---|---|
| SEQ ID NO: (nt/aa) | Amino Acid Differences (Relative to SEQ ID NO: 562) | Amino Acid Differences (Relative to SEQ ID NO: 2)[2] | Unchallenged Activity Improvement (Relative to SEQ ID NO: 562) | Autolysis Stability Improvement (Relative to SEQ ID NO: 562) | Pepsin Pre-Incubation Improvement (Relative to SEQ ID NO: 562) |
| 577/578 | A301V/V347F/ K406R | S205R/M236V/Q258K/E261L/ A301V/N339W/L342R/V347F/ S370C/K406R/A408V/S439M/ V442L/P446R/A449L/N450R/ Q490E/Q505A/R514H/Q536W/ E537P/A545I/E620V/A639T/ A646V | + | ++ | +++ |
| 579/580 | A308E/V347F/ A468S | S205R/M236V/Q258K/E261L/ A308E/N339W/L342R/V347F/ S370C/A408V/S439M/V442L/ P446R/A449L/N450R/A468S/ Q490E/Q505A/R514H/Q536W/ E537P/A545I/E620V/A639T/ A646V | ++ | +++ | +++ |
| 581/582 | A308E/Y336W/ V347F/A468S | S205R/M236V/Q258K/E261L/ A308E/Y336W/N339W/L342R/ V347F/S370C/A408V/S439M/ V442L/P446R/A449L/N450R/ A468S/Q490E/Q505A/R514H/ Q536W/E537P/A545I/E620V/ A639T/A646V | ++ | +++ | |
| 583/584 | C370S/P537E/ T639A | S205R/M236V/Q258K/E261L/ N339W/L342R/A408V/S439M/ V442L/P446R/A449L/N450R/ Q490E/Q505A/R514H/Q536W/ A545I/E620V/A646V | ++ | +++ | + |
| 585/586 | D489Y | S205R/M236V/Q258K/E261L/ N339W/L342R/S370C/A408V/ S439M/V442L/P446R/A449L/ N450R/D489Y/Q490E/Q505A/ R514H/Q536W/E537P/A545I/ E620V/A639T/A646V | +++ | | |
| 587/588 | F543A | S205R/M236V/Q258K/E261L/ N339W/L342R/S370C/A408V/ S439M/V442L/P446R/A449L/ N450R/Q490E/Q505A/R514H/ Q536W/E537P/F543A/A545I/ E620V/A639T/A646V | ++ | +++ | |
| 589/590 | F543V/H673Y | S205R/M236V/Q258K/E261L/ N339W/L342R/S370C/A408V/ S439M/V442L/P446R/A449L/ N450R/Q490E/Q505A/R514H/ Q536W/E537P/F543V/A545I/ E620V/A639T/A646V/H673Y | ++ | +++ | +++ |
| 591/592 | G661D | S205R/M236V/Q258K/E261L/ N339W/L342R/S370C/A408V/ S439M/V442L/P446R/A449L/ N450R/Q490E/Q505A/R514H/ Q536W/E537P/A545I/E620V/ A639T/A646V/G661D | +++ | | + |
| 593/594 | I542M | S205R/M236V/Q258K/E261L/ N339W/L342R/S370C/A408V/ S439M/V442L/P446R/A449L/ N450R/Q490E/Q505A/R514H/ Q536W/E537P/I542M/A545I/ E620V/A639T/A646V | ++ | ++ | ++ |
| 595/596 | K258Q/R342E/ C370S/V408A/ L442V/P537E | S205R/M236V/E261L/N339W/ S439M/P446R/A449L/N450R/ Q490E/Q505A/R514H/Q536W/ A545I/E620V/A639T/A646V | ++ | +++ | |
| 597/598 | L300F/A301V/ V347F/A468S | S205R/M236V/Q258K/E261L/ L300F/A301V/N339W/L342R/ V347F/S370C/A408V/S439M/ V442L/P446R/A449L/N450R/ A468S/Q490E/Q505A/R514H/ Q536W/E537P/A545I/E620V/ A639T/A646V | +++ | +++ | +++ |

TABLE 3.11-continued

| | | | Protease Activity Relative to SEQ ID NO: 562[1] | | |
|---|---|---|---|---|---|
| SEQ ID NO: (nt/aa) | Amino Acid Differences (Relative to SEQ ID NO: 562) | Amino Acid Differences (Relative to SEQ ID NO: 2)[2] | Unchallenged Activity Improvement (Relative to SEQ ID NO: 562) | Autolysis Stability Improvement (Relative to SEQ ID NO: 562) | Pepsin Pre-Incubation Improvement (Relative to SEQ ID NO: 562) |
| 599/600 | P539M/D649H | S205R/M236V/Q258K/E261L/ N339W/L342R/S370C/A408V/ S439M/V442L/P446R/A449L/ N450R/Q490E/Q505A/R514H/ Q536W/E537P/P539M/A545I/ E620V/A639T/A646V/D649H | +++ | | +++ |
| 601/602 | P634C | S205R/M236V/Q258K/E261L/ N339W/L342R/S370C/A408V/ S439M/V442L/P446R/A449L/ N450R/Q490E/Q505A/R514H/ Q536W/E537P/A545I/E620V/ P634C/A639T/A646V | ++ | +++ | ++ |
| 603/604 | R205S/C370S/ P537E | M236V/Q258K/E261L/N339W/ L342R/A408V/S439M/V442L/ P446R/A449L/N450R/Q490E/ Q505A/R514H/Q536W/A545I/ E620V/A639T/A646V | ++ | +++ | ++ |
| 605/606 | R205S/L442V/ A505Q/V620E | M236V/Q258K/E261L/N339W/ L342R/S370C/A408V/S439M/ P446R/A449L/N450R/Q490E/ R514H/Q536W/E537P/A545I/ A639T/A646V | ++ | +++ | |
| 607/608 | R205S/R342L/ M439S/L442V/ H514R/V620E/ T639A | M236V/Q258K/E261L/N339W/ S370C/A408V/P446R/A449L/ N450R/Q490E/Q505A/Q536W/ E537P/A545I/A646V | ++ | +++ | |
| 609/610 | R205S/V236M/ C370S/E490Q/ P537E/V620E | Q258K/E261L/N339W/L342R/ A408V/S439M/V442L/P446R/ A449L/N450R/Q505A/R514H/ Q536W/A545I/A639T/A646V | +++ | | |
| 611/612 | R205S/V236M/ V347F | Q258K/E261L/N339W/L342R/ V347F/S370C/A408V/S439M/ V442L/P446R/A449L/N450R/ Q490E/Q505A/R514H/Q536W/ E537P/A545I/E620V/A639T/ A646V | +++ | | + |
| 613/614 | R342L | S205R/M236V/Q258K/E261L/ N339W/S370C/A408V/S439M/ V442L/P446R/A449L/N450R/ Q490E/Q505A/R514H/Q536W/ E537P/A545I/E620V/A639T/ A646V | ++ | +++ | |
| 615/616 | R342L/V408A/ E490Q/A505Q/ H514R/I545A/ T639A/V646A | S205R/M236V/Q258K/E261L/ N339W/S370C/S439M/V442L/ P446R/A449L/N450R/Q536W/ E537P/E620V | +++ | +++ | |
| 617/618 | R342L/V620E | S205R/M236V/Q258K/E261L/ N339W/S370C/A408V/S439M/ V442L/P446R/A449L/N450R/ Q490E/Q505A/R514H/Q536W/ E537P/A545I/A639T/A646V | ++ | +++ | |
| 619/620 | T558R | S205R/M236V/Q258K/E261L/ N339W/L342R/S370C/A408V/ S439M/V442L/P446R/A449L/ N450R/Q490E/Q505A/R514H/ Q536W/E537P/A545I/T558R/ E620V/A639T/A646V | ++ | ++ | ++ |
| 621/622 | V236M/C370S/ R450N/V620E | S205R/Q258K/E261L/N339W/ L342R/A408V/S439M/V442L/ P446R/A449L/Q490E/Q505A/ R514H/Q536W/E537P/A545I/ A639T/A646V | +++ | | |
| 623/624 | V236M/K258Q/ C370S/A505Q/ I545A/T639A | S205R/E261L/N339W/L342R/ A408V/S439M/V442L/P446R/ A449L/N450R/Q490E/R514H/ Q536W/E537P/E620V/A646V | ++ | +++ | |
| 625/626 | V236M/W339N/ H514R | S205R/Q258K/E261L/L342R/ S370C/A408V/S439M/V442L/ P446R/A449L/N450R/Q490E/ Q505A/Q536W/E537P/A545I/ E620V/A639T/A646V | +++ | ++ | |

TABLE 3.11-continued

Protease Activity Relative to SEQ ID NO: 562[1]

| SEQ ID NO: (nt/aa) | Amino Acid Differences (Relative to SEQ ID NO: 562) | Amino Acid Differences (Relative to SEQ ID NO: 2)[2] | Unchallenged Activity Improvement (Relative to SEQ ID NO: 562) | Autolysis Stability Improvement (Relative to SEQ ID NO: 562) | Pepsin Pre-Incubation Improvement (Relative to SEQ ID NO: 562) |
|---|---|---|---|---|---|
| 627/628 | A301V/A308E/ A468S/M601I | S205R/M236V/Q258K/E261L/ A301V/A308E/N339W/L342R/ S370C/A408V/S439M/V442L/ P446R/A449L/N450R/A468S/ Q490E/Q505A/R514H/Q536W/ E537P/A545I/M601I/E620V/ A639T/A646V | | | +++ |
| 629/630 | A301V/A308E/ Y336W/V346K/ K406R/A468S/ M601I | S205R/M236V/Q258K/E261L/ A301V/A308E/Y336W/N339W/ L342R/V346K/S370C/K406R/ A408V/S439M/V442L/P446R/ A449L/N450R/A468S/Q490E/ Q505A/R514H/Q536W/E537P/ A545I/M601I/E620V/A639T/ A646V | | | |
| 631/632 | C370S/L442V | S205R/M236V/Q258K/E261L/ N339W/L342R/A408V/S439M/ P446R/A449L/N450R/Q490E/ Q505A/R514H/Q536W/E537P/ A545I/E620V/A639T/A646V | + | | |
| 633/634 | K258Q/W339N/ R342L/A505Q/ P537E | S205R/M236V/E261L/S370C/ A408V/S439M/V442L/P446R/ A449L/N450R/Q490E/R514H/ Q536W/A545I/E620V/A639T/ A646V | ++ | | |
| 635/636 | L133M/A301V/ V346K/V347F/ A468S | L133M/S205R/M236V/Q258K/ E261L/A301V/N339W/L342R/ V346K/V347F/S370C/A408V/ S439M/V442L/P446R/A449L/ N450R/A468S/Q490E/Q505A/ R514H/Q536W/E537P/A545I/ E620V/A639T/A646V | | | +++ |
| 637/638 | L300F/A301V/ A308E/V346K/ V347F/A468S | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/E620V/A639T/A646V | +++ | | +++ |
| 639/640 | L559H | S205R/M236V/Q258K/E261L/ N339W/L342R/S370C/A408V/ S439M/V442L/P446R/A449L/ N450R/Q490E/Q505A/R514H/ Q536W/E537P/A545I/L559H/ E620V/A639T/A646V | ++ | | + |
| 641/642 | L559S | S205R/M236V/Q258K/E261L/ N339W/L342R/S370C/A408V/ S439M/V442L/P446R/A449L/ N450R/Q490E/Q505A/R514H/ Q536W/E537P/A545I/L559S/ E620V/A639T/A646V | ++ | | + |
| 643/644 | T566G | S205R/M236V/Q258K/E261L/ N339W/L342R/S370C/A408V/ S439M/V442L/P446R/A449L/ N450R/Q490E/Q505A/R514H/ Q536W/E537P/A545I/T566G/ E620V/A639T/A646V | ++ | | |
| 645/646 | V236M/I545A | S205R/Q258K/E261L/N339W/ L342R/S370C/A408V/S439M/ V442L/P446R/A449L/N450R/ Q490E/Q505A/R514H/Q536W/ E537P/E620V/A639T/A646V | ++ | | |

[1] All activities were determined relative to the reference polypeptide of SEQ ID NO: 562. Levels of increased activity are defined as follows: "+" = 0.9 to 1.1; "++" > 1.1; "+++" > 1.5; and "++++" > 3.
[2] Amino Acid Differences does not include Histidine tag at C-terminus

TABLE 3.12

Protease Activity Relative to SEQ ID NO: 562[1]

| SEQ ID NO: (nt/aa) | Amino Acid Differences (Relative to SEQ ID NO: 562) | Amino Acid Differences (Relative to SEQ ID NO: 2)[2] | Unchallenged Activity Improvement (Relative to SEQ ID NO: 562) | Autolysis Stability Improvement (Relative to SEQ ID NO: 562) | Pepsin Pre-Incubation Improvement (Relative to SEQ ID NO: 562) |
|---|---|---|---|---|---|
| 647/648 | A301V/A308E/V346K/V347F/A468S | S205R/M236V/Q258K/E261L/A301V/A308E/N339W/L342R/V346K/V347F/S370C/A408V/S439M/V442L/P446R/A449L/A468S/N450R/Q490E/Q505A/R514H/Q536W/E537P/A545I/E620V/A639T/A646V | + | | +++ |
| 649/650 | A301V/Y336W/V346K/V347F/K406R/M601I | S205R/M236V/Q258K/E261L/A301V/Y336W/N339W/L342R/V346K/V347F/S370C/K406R/A408V/S439M/V442L/P446R/A449L/N450R/Q490E/Q505A/R514H/Q536W/E537P/A545I/M601I/E620V/A639T/A646V | | ++ | ++++ |
| 651/652 | A308E/Y336W/V347F/K406R/A468S/M601I | S205R/M236V/Q258K/E261L/A308E/Y336W/N339W/L342R/V347F/S370C/K406R/A408V/S439M/V442L/P446R/A449L/A468S/N450R/Q490E/Q505A/R514H/Q536W/E537P/A545I/M601I/E620V/A639T/A646V | ++ | +++ | |
| 653/654 | L300F/A301V/A308E/Y336W/V347F/A468S/M601I | S205R/M236V/Q258K/E261L/L300F/A301V/A308E/Y336W/N339W/L342R/V347F/S370C/A408V/S439M/V442L/P446R/A449L/N450R/A468S/Q490E/Q505A/R514H/Q536W/E537P/A545I/M601I/E620V/A639T/A646V | | + | ++ |
| 655/656 | L300F/A301V/V347F/K406R | S205R/M236V/Q258K/E261L/L300F/A301V/N339W/L342R/V347F/S370C/K406R/A408V/S439M/V442L/P446R/A449L/N450R/Q490E/Q505A/R514H/Q536W/E537P/A545I/E620V/A639T/A646V | +++ | +++ | +++ |
| 657/658 | R205S/V236M/R342L/M439S/A505Q/H514R/P537E/I545A | Q258K/E261L/N339W/S370C/A408V/V442L/P446R/A449L/N450R/Q490E/Q536W/E620V/A639T/A646V | +++ | +++ | |
| 659/660 | V236M/R342L/A505Q/H514R/P537E/I545A | S205R/Q258K/E261L/N339W/S370C/A408V/S439M/V442L/P446R/A449L/N450R/Q490E/Q536W/E620V/A639T/A646V | +++ | +++ | |

[1] All activities were determined relative to the reference polypeptide of SEQ ID NO: 562. Levels of increased activity are defined as follows: "+" = 0.9 to 1.1; "++" > 1.1; "+++" > 1.5; and "++++" > 3.
[2] Amino Acid Differences does not include Histidine tag at C-terminus Based on the results shown in Table 3.11, SEQ ID NO: 638 was chosen as the next parent sequence for the next iteration of protein optimization. Beneficial mutations identified from the results shown in Table 3.11 were recombined into this backbone. Additionally, variants were also constructed using SEQ ID NO: 638, with saturation mutagenesis at different positions. The variants were assayed in triplicate for protease activity at pH 6, after a pre-incubation at pH 3.26 with 1.5 mg/mL pepsin for 1 hr with the alternate BAEE assay at pH 7.5, and for autolysis stability by measuring the protease activity after 1 day of incubation at room temperature as described in Example 2. The results (relative to the results obtained for SEQ ID NO: 638) are provided in Table 3.13. In additional experiments, some of the protease variants were purified and assayed in triplicate for protease activity at pH 6, after a pre-incubation at pH 3.5 with 1.5 mg/mL pepsin for 1 hr, and also for autolysis stability by measuring the protease activity after 1 day of incubation at room temperature as described in Example 2. Analysis of the data relative to SEQ ID NO: 638 are listed in Table 3.14.

TABLE 3.13

| SEQ ID NO: (nt/aa) | Amino Acid Differences (Relative to SEQ ID NO: 638) | Amino Acid Differences (Relative to SEQ ID NO: 2)[2] | Protease Activity Relative to SEQ ID NO: 638[1] |||
|---|---|---|---|---|---|
| | | | Unchallenged Activity Improvement (Relative to SEQ ID NO: 638) | Autolysis Stability Improvement (Relative to SEQ ID NO: 638) | Pepsin Pre-Incubation Improvement (Relative to SEQ ID NO: 638) |
| 661/662 | A511S/P537E | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/A511S/R514H/Q536W/ A545I/E620V/A639T/A646V | + | +++ | ++ |
| 663/664 | K346V/A511S/ I542S/Y582R | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/E537P/ I542S/A545I/Y582R/E620V/ A639T/A646V | + | ++ | +++ |
| 665/666 | K346V/A511S/ I583R | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/E537P/ A545I/I583R/E620V/A639T/ A646V | | ++ | ++ |
| 667/668 | K346V/A511S/ S581L/Y582R | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/E537P/ A545I/S581L/Y582R/E620V/ A639T/A646V | + | ++ | ++ |
| 669/670 | K346V/V529G/ S571I/S581C/ Y582V/I583V/ T589A | S205R/M236V/Q258K/E261L/ L300F/A301V/A308E/N339W/ L342R/V347F/S370C/A408V/ S439M/V442L/P446R/A449L/ N450R/A468S/Q490E/Q505A/ R514H/V529G/Q536W/E537P/ A545I/S571I/S581C/Y582V/ I583V/T589A/E620V/A639T/ A646V | ++ | +++ | ++ |
| 671/672 | L568R/F662W/ E663W | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/L568R/E620V/A639T/ A646V/F662W/E663W | | ++ | +++ |
| 673/674 | P516M/P539E/ L568R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/P516M/Q536W/ E537P/P539E/A545I/L568R/ E620V/A639T/A646V | +++ | ++ | ++ |
| 675/676 | P537E/Y582R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/A545I/ Y582R/E620V/A639T/A646V | + | ++ | +++ |
| 677/678 | P539E | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ P539E/A545I/E620V/A639T/ A646V | +++ | +++ | ++ |

TABLE 3.13-continued

Protease Activity Relative to SEQ ID NO: 638[1]

| SEQ ID NO: (nt/aa) | Amino Acid Differences (Relative to SEQ ID NO: 638) | Amino Acid Differences (Relative to SEQ ID NO: 2)[2] | Unchallenged Activity Improvement (Relative to SEQ ID NO: 638) | Autolysis Stability Improvement (Relative to SEQ ID NO: 638) | Pepsin Pre-Incubation Improvement (Relative to SEQ ID NO: 638) |
|---|---|---|---|---|---|
| 679/680 | S581L/Y582R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/S581L/Y582R/E620V/ A639T/A646V | | | +++ |
| 681/682 | K346V/A511S/ P537E/S541I/ F543G | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/S541I/ F543G/A545I/E620V/A639T/ A646V | | | +++ |
| 683/684 | K346V/A511S/ P537E | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/A545I/ E620V/A639T/A646V | | | ++ |

[1]All activities were determined relative to the reference polypeptide of SEQ ID NO: 638. Levels of increased activity are defined as follows: "+" = 0.9 to 1.1; "++" > 1.1; "+++" > 1.5; and "++++" > 3.
[2]Amino Acid Differences does not include Histidine tag at C-terminus

TABLE 3.14

Protease Activity Relative to SEQ ID NO: 638[1]

| SEQ ID NO: (nt/aa) | Amino Acid Differences (Relative to SEQ ID NO: 638) | Amino Acid Differences (Relative to SEQ ID NO: 638)[2] | Unchallenged Activity Improvement (Relative to SEQ ID NO: 638) | Autolysis Stability Improvement (Relative to SEQ ID NO: 638) | Pepsin Pre-Incubation Improvement (Relative to SEQ ID NO: 638) |
|---|---|---|---|---|---|
| 685/686 | I650G | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/E620V/A639T/A646V/ I650G | + | ++ | ++ |
| 687/688 | Q647W | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/E620V/A639T/A646V/ Q647W | | ++ | + |
| 689/690 | K346V/I583R | S205R/M236V/Q258K/E261L/ L300F/A301V/A308E/N339W/ L342R/V347F/S370C/A408V/ S439M/V442L/P446R/A449L/ N450R/A468S/Q490E/Q505A/ R514H/Q536W/E537P/A545I/ I583R/E620V/A639T/A646V | ++ | +++ | ++ |
| 691/692 | P516M | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/P516M/Q536W/ E537P/A545I/E620V/A639T/ A646V | | ++ | |

TABLE 3.14-continued

| | | | Protease Activity Relative to SEQ ID NO: 638[1] | | |
|---|---|---|---|---|---|
| SEQ ID NO: (nt/aa) | Amino Acid Differences (Relative to SEQ ID NO: 638) | Amino Acid Differences (Relative to SEQ ID NO: 638)[2] | Unchallenged Activity Improvement (Relative to SEQ ID NO: 638) | Autolysis Stability Improvement (Relative to SEQ ID NO: 638) | Pepsin Pre-Incubation Improvement (Relative to SEQ ID NO: 638) |
| 693/694 | Y582V | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/Y582V/E620V/A639T/ A646V | + | ++ | ++ |
| 695/696 | K346V/A511S/ F543G/Y582R | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/E537P/ F543G/A545I/Y582R/E620V/ A639T/A646V | +++ | +++ | ++ |
| 697/698 | Q664R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/E620V/A639T/A646V/ Q664R | ++ | + | ++ |
| 699/700 | L559S | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/L559S/E620V/A639T/ A646V | | ++ | |
| 701/702 | L559S/L568R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/L559S/L568R/E620V/ A639T/A646V | | | |
| 703/704 | Q647L | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/E620V/A639T/A646V/ Q647L | + | ++ | |
| 705/706 | A511S/P537E/ I542S/Y582R/ I583R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/A511S/R514H/Q536W/ I542S/A545I/Y582R/I583R/ E620V/A639T/A646V | +++ | +++ | ++ |
| 707/708 | V549G | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/V549G/E620V/A639T/ A646V | | ++ | |

TABLE 3.14-continued

| | | | Protease Activity Relative to SEQ ID NO: 638[1] | | |
|---|---|---|---|---|---|
| SEQ ID NO: (nt/aa) | Amino Acid Differences (Relative to SEQ ID NO: 638) | Amino Acid Differences (Relative to SEQ ID NO: 638)[2] | Unchallenged Activity Improvement (Relative to SEQ ID NO: 638) | Autolysis Stability Improvement (Relative to SEQ ID NO: 638) | Pepsin Pre-Incubation Improvement (Relative to SEQ ID NO: 638) |
| 709/710 | D548R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ A545I/D548R/E620V/A639T/ A646V | | +++ | ++ |
| 711/712 | K346V/A511S/ P537E/Y582V | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/A545I/ Y582V/E620V/A639T/A646V | +++ | +++ | ++ |
| 713/714 | K346V/A511S/ T544L | S205R/M236V/Q258K/E261L/ L300F/A301V/A308E/N339W/ L342R/V347F/S370C/A408V/ S439M/V442L/P446R/A449L/ N450R/A468S/Q490E/Q505A/ A511S/R514H/Q536W/E537P/ T544L/A545I/E620V/A639T/ A646V | | +++ | + |
| 715/716 | P537E/F543G/ Y582R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/F543G/ A545I/Y582R/E620V/A639T/ A646V | +++ | +++ | ++ |
| 717/718 | I542S/T544L/ S581R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ I542S/T544L/A545I/S581R/ E620V/A639T/A646V | ++ | +++ | + |
| 719/720 | K346V/P537E/ I542S/T544L | S205R/M236V/Q258K/E261L/ L300F/A301V/A308E/N339W/ L342R/V347F/S370C/A408V/ S439M/V442L/P446R/A449L/ N450R/A468S/Q490E/Q505A/ R514H/Q536W/I542S/T544L/ A545I/E620V/A639T/A646V | +++ | ++ | ++ |
| 721/722 | V540G | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ V540G/A545I/E620V/A639T/ A646V | +++ | +++ | ++ |
| 723/724 | P539E/L568R | S205R/M236V/Q258K/E261L/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ P539E/A545I/L568R/E620V/ A639T/A646V | +++ | + | ++ |
| 725/726 | K346V/F543G/ T544L | S205R/M236V/Q258K/E261L/ L300F/A301V/A308E/N339W/ L342R/V347F/S370C/A408V/ S439M/V442L/P446R/A449L/ N450R/A468S/Q490E/Q505A/ R514H/Q536W/E537P/F543G/ T544L/A545I/E620V/A639T/ A646V | +++ | | ++ |

TABLE 3.14-continued

Protease Activity Relative to SEQ ID NO: 638[1]

| SEQ ID NO: (nt/aa) | Amino Acid Differences (Relative to SEQ ID NO: 638) | Amino Acid Differences (Relative to SEQ ID NO: 638)[2] | Unchallenged Activity Improvement (Relative to SEQ ID NO: 638) | Autolysis Stability Improvement (Relative to SEQ ID NO: 638) | Pepsin Pre-Incubation Improvement (Relative to SEQ ID NO: 638) |
|---|---|---|---|---|---|
| 727/728 | P516M/P539E/E555G | S205R/M236V/Q258K/E261L/L300F/A301V/A308E/N339W/L342R/V346K/V347F/S370C/A408V/S439M/V442L/P446R/A449L/N450R/A468S/Q490E/Q505A/R514H/P516M/Q536W/E537P/P539E/A545I/E555G/E620V/A639T/A646V | +++ | | ++ |

[1]All activities were determined relative to the reference polypeptide of SEQ ID NO: 638. Levels of increased activity are defined as follows: "+" = 0.9 to 1.1; "++" > 1.1; "+++" > 1.5; and "++++" > 3.
[2]Amino Acid Differences does not include Histidine tag at C-terminus Based on the results from Table 3.13, SEQ ID NO: 680 was chosen as the next parent sequence for the next iteration of protein optimization. Beneficial mutations identified from Table 3.13 and Table 3.14 were recombined into this backbone. The variants were purified and assayed in triplicate for protease activity at pH 6, after a pre-incubation at pH 3.25, with 1.5 mg/mL pepsin for 1 hr, and for autolysis stability by measuring the protease activity after 1 day of incubation at room temperature as described in Example 2. The results (relative to those obtained for SEQ ID NO: 680) are provided in Table 3.15.

Table 3.15 Protease Activity Relative to SEQ ID NO: 680[1]

| SEQ ID NO: (nt/aa) | Amino Acid Differences (Relative to SEQ ID NO: 680) | Amino Acid Differences (Relative to SEQ ID NO: 2)[2] | Unchallenged Activity Improvement (Relative to SEQ ID NO: 680) | Autolysis Stability Improvement (Relative to SEQ ID NO: 680) | Pepsin Pre-Incubation Improvement (Relative to SEQ ID NO: 680) |
|---|---|---|---|---|---|
| 729/730 | A511D | S205R/M236V/Q258K/E26IL/L300F/A301V/A308E/N339W/L342R/V346K/V347F/S370C/A408V/S439M/V442L/P446R/A449L/N450R/A468S/Q490E/Q505A/A511D/R514H/Q536W/E537P/A545I/S581L/Y582R/E620V/A639T/A646V | + | + | + |
| 731/732 | A511D/D567R | S205R/M236V/Q258K/E26IL/L300F/A301V/A308E/N339W/L342R/V346K/V347F/S370C/A408V/S439M/V442L/P446R/A449L/N450R/A468S/Q490E/Q505A/A511D/R514H/Q536W/E537P/A545I/D567R/S581L/Y582R/E620V/A639T/A646V | + | ++ | + |
| 733/734 | A511D/P539L/F543A | S205R/M236V/Q258K/E261L/L300F/A301V/A308E/N339W/L342R/V346K/V347F/S370C/A408V/S439M/V442L/P446R/A449L/N450R/A468S/Q490E/Q505A/A511D/R514H/Q536W/E537P/P539L/F543A/A545I/S581L/Y582R/E620V/A639T/A646V | ++ | +++ | + |
| 735/736 | F543A | S205R/M236V/Q258K/E261L/L300F/A301V/A308E/N339W/L342R/V346K/V347F/S370C/A408V/S439M/V442L/P446R/A449L/N450R/A468S/Q490E/Q505A/R514H/Q536W/E537P/F543A/A545I/S581L/Y582R/E620V/A639T/A646V | + | ++ | ++ |
| 737/738 | I583E | S205R/M236V/Q258K/E261L/L300F/A301V/A308E/N339W/L342R/V346K/V347F/S370C/A408V/S439M/V442L/P446R/A449L/N450R/A468S/Q490E/ | | +++ | ++ |

Table 3.15 Protease Activity Relative to SEQ ID NO: 680[1]

| SEQ ID NO: (nt/aa) | Amino Acid Differences (Relative to SEQ ID NO: 680) | Amino Acid Differences (Relative to SEQ ID NO: 2)[2] | Unchallenged Activity Improvement (Relative to SEQ ID NO: 680) | Autolysis Stability Improvement (Relative to SEQ ID NO: 680) | Pepsin Pre-Incubation Improvement (Relative to SEQ ID NO: 680) |
|---|---|---|---|---|---|
| | | Q505A/R514H/Q536W/E537P/ A545I/S581L/Y582R/I583E/ E620V/A639T/A646V | | | |
| 739/740 | L261D/D489E/ A511D/L568R | S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/A511D/R514H/ Q536W/E537P/A545I/L568R/ S581L/Y582R/E620V/A639T/ A646V | | | ++ |
| 741/742 | L261D/D489E/ D567R | S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/D567R/S581L/ Y582R/E620V/A639T/A646V | | ++ | +++ |
| 743/744 | L261D/D489E/ P539L | S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/P539L/A545I/S581L/ Y582R/E620V/A639T/A646V | ++ | ++ | +++ |
| 745/746 | L261D/I542L/ F543A/L568R | S205R/M236V/Q258K/E261D/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ I542L/F543A/A545I/L568R/ S581L/Y582R/E620V/A639T/ A646V | + | + | +++ |
| 747/748 | L261D/L355C/ D567R/L568R | S205R/M236V/Q258K/E261D/ L300F/A301V/A308E/N339W/ L342R/V346K/V347F/L355C/ S370C/A408V/S439M/V442L/ P446R/A449L/N450R/A468S/ Q490E/Q505A/R514H/Q536W/ E537P/A545I/D567R/L568R/ S581L/Y582R/E620V/A639T/ A646V | ++ | | +++ |
| 749/750 | L261D/L355C/ F543A | S205R/M236V/Q258K/E261D/ L300F/A301V/A308E/N339W/ L342R/V346K/V347F/L355C/ S370C/A408V/S439M/V442L/ P446R/A449L/N450R/A468S/ Q490E/Q505A/R514H/Q536W/ E537P/F543A/A545I/S581L/ Y582R/E620V/A639T/A646V | + | + | ++ |
| 751/752 | L261D/P539L/ F543A | S205R/M236V/Q258K/E261D/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ P539L/F543A/A545I/S581L/ Y582R/E620V/A639T/A646V | + | + | +++ |

-continued

Table 3.15 Protease Activity Relative to SEQ ID NO: 680[1]

| SEQ ID NO: (nt/aa) | Amino Acid Differences (Relative to SEQ ID NO: 680) | Amino Acid Differences (Relative to SEQ ID NO: 2)[2] | Unchallenged Activity Improvement (Relative to SEQ ID NO: 680) | Autolysis Stability Improvement (Relative to SEQ ID NO: 680) | Pepsin Pre-Incubation Improvement (Relative to SEQ ID NO: 680) |
|---|---|---|---|---|---|
| 753/754 | L261D/P539L/ F543D/D567R | S205R/M236V/Q258K/E261D/ L300F/A301V/A308E/N339W/ L342R/V346K/V347F/S370C/ A408V/S439M/V442L/P446R/ A449L/N450R/A468S/Q490E/ Q505A/R514H/Q536W/E537P/ P539L/F543D/A545I/D567R/ S581L/Y582R/E620V/A639T/ A646V | + | ++ | + |
| 755/756 | L261D/D489E | S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | | +++ |

[1]All activities were determined relative to the reference polypeptide of SEQ ID NO: 680. Levels of increased activity are defined as follows: "+" = 0.9 to 1.1; "++" > 1.1; "+++" > 1.5; and "++++" > 3.
[2]Amino Acid Differences does not include Histidine tag at C-terminus Based on the results shown in Table 3.15, SEQ ID NO: 756 was chosen as the next parent sequence for the next iteration of protein optimization. Beneficial mutations identified from the results shown in Table 13.15 were recombined into this backbone. Additionally, variants were also constructed using SEQ ID NO: 756, with homolog diversity. The variants were purified and assayed in triplicate for protease activity at pH6, after a pre-incubation at pH 3.25 with 1.5 mg/mL pepsin for 1 hr, and for autolysis stability by measuring the protease activity after 1 day of incubation at room temperature as described in Example 2. The results (relative to the results obtained for SEQ ID NO: 756) are provided in Table 3.16. In some additional experiments, some of the protease variants were purified and assayed in triplicate for protease activity at pH 6, after a pre-incubation at pH 3.5 with 1.5 mg/mL pepsin for 1 hr, and for autolysis stability by measuring the protease activity after 1 day of incubation at room temperature, as described in Example 2. The results (relative to the results obtained for SEQ ID NO: 756) are provided in Table 3.17.

TABLE 3.16

Protease Activity Relative to SEQ ID NO: 756[1]

| SEQ ID NO: (nt/aa) | Amino Acid Differences (Relative to SEQ ID NO: 756) | Amino Acid Differences (Relative to SEQ ID NO: 2)[2] | Unchallenged Activity Improvement UC (Relative to SEQ ID NO: 756) | Autolysis Stability Improvement (Relative to SEQ ID NO: 756) | Pepsin Pre-Incubation Improvement (Relative to SEQ ID NO: 756) |
|---|---|---|---|---|---|
| 757/758 | A93E | A93E/S205R/M236V/Q258K/ E261D/L300F/A301V/A308E/ N339W/L342R/V346K/V347F/ S370C/A408V/S439M/V442L/ P446R/A449L/N450R/A468S/ D489E/Q490E/Q505A/R514H/ Q536W/E537P/A545I/S581L/ Y582R/E620V/A639T/A646V | | + | ++ |
| 759/760 | I32A/T34M/ A93E | I32A/T34M/A93E/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | | | ++ |
| 761/762 | N50S/N77D/ A93E | N50S/N77D/A93E/S205R/ M236V/Q258K/E261D/L300F/ A301V/A308E/N339W/L342R/ V346K/V347F/S370C/A408V/ S439M/V442L/P446R/A449L/ | + | ++ | + |

TABLE 3.16-continued

| | | | Protease Activity Relative to SEQ ID NO: 756[1] | | |
|---|---|---|---|---|---|
| SEQ ID NO: (nt/aa) | Amino Acid Differences (Relative to SEQ ID NO: 756) | Amino Acid Differences (Relative to SEQ ID NO: 2)[2] | Unchallenged Activity Improvement UC (Relative to SEQ ID NO: 756) | Autolysis Stability Improvement (Relative to SEQ ID NO: 756) | Pepsin Pre-Incubation Improvement (Relative to SEQ ID NO: 756) |
| | | N450R/A468S/D489E/Q490E/ Q505A/R514H/Q536W/E537P/ A545I/S581L/Y582R/E620V/ A639T/A646V | | | |
| 763/764 | N77D/A93E | N77D/A93E/S205R/M236V/ Q258K/E261D/L300F/A301V/ A308E/N339W/L342R/V346K/ V347F/S370C/A408V/S439M/ V442L/P446R/A449L/N450R/ A468S/D489E/Q490E/Q505A/ R514H/Q536W/E537P/A545I/ S581L/Y582R/E620V/A639T/ A646V | | | ++ |
| 765/766 | P470Q | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V | | + | +++ |
| 767/768 | R205L/R263V/ P470Q | S205L/M236V/Q258K/E261D/ R263V/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V | | | +++ |
| 769/770 | R263I/E489D | S205R/M236V/Q258K/E261D/ R263I/L300F/A301V/A308E/ N339W/L342R/V346K/V347F/ S370C/A408V/S439M/V442L/ P446R/A449L/N450R/A468S/ Q490E/Q505A/R514H/Q536W/ E537P/A545I/S581L/Y582R/ E620V/A639T/A646V | ++ | +++ | + |
| 771/772 | R263I/N344V/ Q664R | S205R/M236V/Q258K/E261D/ R263I/L300F/A301V/A308E/ N339W/L342R/N344V/V346K/ V347F/S370C/A408V/S439M/ V442L/P446R/A449L/N450R/ A468S/D489E/Q490E/Q505A/ R514H/Q536W/E537P/A545I/ S581L/Y582R/E620V/A639T/ A646V/Q664R | + | | +++ |
| 773/774 | R9K | R9K/S205R/M236V/Q258K/ E261D/L300F/A301V/A308E/ N339W/L342R/V346K/V347F/ S370C/A408V/S439M/V442L/ P446R/A449L/N450R/A468S/ D489E/Q490E/Q505A/R514H/ Q536W/E537P/A545I/S581L/ Y582R/E620V/A639T/A646V | + | +++ | ++ |
| 775/776 | R9K/A93E | R9K/A93E/S205R/M236V/ Q258K/E261D/L300F/A301V/ A308E/N339W/L342R/V346K/ V347F/S370C/A408V/S439M/ V442L/P446R/A449L/N450R/ A468S/D489E/Q490E/Q505A/ R514H/Q536W/E537P/A545I/ S581L/Y582R/E620V/A639T/ A646V | + | ++ | ++ |
| 777/778 | R9K/I32A/ N77D/A93E | R9K/I32A/N77D/A93E/ S205R/M236V/Q258K/E261D/ L300F/A301V/A308E/N339W/ L342R/V346K/V347F/S370C/ A408V/S439M/V442L/P446R/ A449L/N450R/A468S/D489E/ | | | + |

TABLE 3.16-continued

| | | | Protease Activity Relative to SEQ ID NO: 756[1] | | |
|---|---|---|---|---|---|
| SEQ ID NO: (nt/aa) | Amino Acid Differences (Relative to SEQ ID NO: 756) | Amino Acid Differences (Relative to SEQ ID NO: 2)[2] | Unchallenged Activity Improvement UC (Relative to SEQ ID NO: 756) | Autolysis Stability Improvement (Relative to SEQ ID NO: 756) | Pepsin Pre-Incubation Improvement (Relative to SEQ ID NO: 756) |
| | | Q490E/Q505A/R514H/Q536W/ E537P/A545I/S581L/Y582R/ E620V/A639T/A646V | | | |
| 779/780 | R9K/N29S/ E35G/S43P/ N77D/I542V/ L554M | R9K/N29S/E35G/S43P/ N77D/S205R/M236V/Q258K/ E261D/L300F/A301V/A308E/ N339W/L342R/V346K/V347F/ S370C/A408V/S439M/V442L/ P446R/A449L/N450R/A468S/ D489E/Q490E/Q505A/R514H/ Q536W/E537P/I542V/A545I/ L554M/S581L/Y582R/E620V/ A639T/A646V | + | | ++ |
| 781/782 | R9K/N50S/ A63E/A93E | R9K/N50S/A63E/A93E/ S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | | ++ |
| 783/784 | R9K/S43P/ N77D | R9K/S43P/N77D/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | | + | + |
| 785/786 | R9K/T17A/ A93E | R9K/T17A/A93E/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | + | + | + |
| 787/788 | R9K/T17A/ N50S | R9K/T17A/N50S/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | ++ | ++ | ++ |
| 789/790 | R9K/T17A/ T34M/E35G/ A93E/L554M | R9K/T17A/T34M/E35G/ A93E/S205R/M236V/Q258K/ E261D/L300F/A301V/A308E/ N339W/L342R/V346K/V347F/ S370C/A408V/S439M/V442L/ P446R/A449L/N450R/A468S/ D489E/Q490E/Q505A/R514H/ Q536W/E537P/A545I/L554M/ S581L/Y582R/E620V/A639T/ A646V | | | ++ |
| 791/792 | R9Q/T17A/ A93E | R9Q/T17A/A93E/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | | ++ | ++ |
| 793/794 | S43P | S43P/S205R/M236V/Q258K/ E261D/L300F/A301V/A308E/ N339W/L342R/V346K/V347F/ | | + | + |

TABLE 3.16-continued

| | | | Protease Activity Relative to SEQ ID NO: 756[1] | | |
|---|---|---|---|---|---|
| SEQ ID NO: (nt/aa) | Amino Acid Differences (Relative to SEQ ID NO: 756) | Amino Acid Differences (Relative to SEQ ID NO: 2)[2] | Unchallenged Activity Improvement UC (Relative to SEQ ID NO: 756) | Autolysis Stability Improvement (Relative to SEQ ID NO: 756) | Pepsin Pre-Incubation Improvement (Relative to SEQ ID NO: 756) |
| 795/796 | T17A/I32A/ T34M/E35G | S370C/A408V/S439M/V442L/ P446R/A449L/N450R/A468S/ D489E/Q490E/Q505A/R514H/ Q536W/E537P/A545I/S581L/ Y582R/E620V/A639T/A646V T17A/I32A/T34M/E35G/ S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | | + |
| 797/798 | T17A/N77D | T17A/N77D/S205R/M236V/ Q258K/E261D/L300F/A301V/ A308E/N339W/L342R/V346K/ V347F/S370C/A408V/S439M/ V442L/P446R/A449L/N450R/ A468S/D489E/Q490E/Q505A/ R514H/Q536W/E537P/A545I/ S581L/Y582R/E620V/A639T/ A646V | ++ | + | ++ |
| 799/800 | I542L/F543A | S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/I542L/F543A/A545I/ S581L/Y582R/E620V/A639T/ A646V | +++ | | ++ |
| 801/802 | R263I/P539L/ S541R/L568R/ K645S | S205R/M236V/Q258K/E261D/ R263I/L300F/A301V/A308E/ N339W/L342R/V346K/V347F/ S370C/A408V/S439M/V442L/ P446R/A449L/N450R/A468S/ D489E/Q490E/Q505A/R514H/ Q536W/E537P/P539L/S541R/ A545I/L568R/S581L/Y582R/ E620V/A639T/K645S/A646V | ++ | | + |
| 803/804 | T17A/N29S/ T34M/E35G/ T36D/N77D/ A93E | T17A/N29S/T34M/E35G/ T36D/N77D/A93E/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | + | | + |
| 805/806 | N50S/A93E | N50S/A93E/S205R/M236V/ Q258K/E261D/L300F/A301V/ A308E/N339W/L342R/V346K/ V347F/S370C/A408V/S439M/ V442L/P446R/A449L/N450R/ A468S/D489E/Q490E/Q505A/ R514H/Q536W/E537P/A545I/ S581L/Y582R/E620V/A639T/ A646V | + | | ++ |
| 807/808 | P470Q/E489D | S205R/M236V/Q258K/E261D/ L300F/A301V/A308E/N339W/ L342R/V346K/V347F/S370C/ A408V/S439M/V442L/P446R/ A449L/N450R/A468S/P470Q/ Q490E/Q505A/R514H/Q536W/ E537P/A545I/S581L/Y582R/ E620V/A639T/A646V | | | +++ |
| 809/810 | R263I/P470Q/ K645S | S205R/M236V/Q258K/E261D/ R263I/L300F/A301V/A308E/ N339W/L342R/V346K/V347F/ | | | ++++ |

TABLE 3.16-continued

| | | Protease Activity Relative to SEQ ID NO: 756[1] | | | |
|---|---|---|---|---|---|
| SEQ ID NO: (nt/aa) | Amino Acid Differences Improvements (Relative to SEQ ID NO: 756) | Amino Acid Differences (Relative to SEQ ID NO: 2)[2] | Unchallenged Activity Improvement UC (Relative to SEQ ID NO: 756) | Autolysis Stability Improvement (Relative to SEQ ID NO: 756) | Pepsin Pre-Incubation Improvement (Relative to SEQ ID NO: 756) |
| | | S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ K645S/A646V | | | |
| 811/812 | P470Q/Q664R | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664R | | | ++++ |
| 813/814 | N344V/L355C/ P470Q/E489D/ K645S | S205R/M236V/Q258K/E261D/ L300F/A301V/A308E/N339W/ L342R/N344V/V346K/V347F/ L355C/S370C/A408V/S439M/ V442L/P446R/A449L/N450R/ A468S/P470Q/Q490E/Q505A/ R514H/Q536W/E537P/A545I/ S581L/Y582R/E620V/A639T/ K645S/A646V | | | ++++ |
| 815/816 | R205L/N344V/ P470Q/N565A | S205L/M236V/Q258K/E261D/ L300F/A301V/A308E/N339W/ L342R/N344V/V346K/V347F/ S370C/A408V/S439M/V442L/ P446R/A449L/N450R/A468S/ P470Q/D489E/Q490E/Q505A/ R514H/Q536W/E537P/A545I/ N565A/S581L/Y582R/E620V/ A639T/A646V | | | +++ |
| 817/818 | R205L/Q345P/ P470Q/S538T/ Q664R | S205L/M236V/Q258K/E261D/ L300F/A301V/A308E/N339W/ L342R/Q345P/V346K/V347F/ S370C/A408V/S439M/V442L/ P446R/A449L/N450R/A468S/ P470Q/D489E/Q490E/Q505A/ R514H/Q536W/E537P/S538T/ A545I/S581L/Y582R/E620V/ A639T/A646V/Q664R | | | +++ |
| 819/820 | P470Q/D567R/ L568R | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/D567R/ L568R/S581L/Y582R/E620V/ A639T/A646V | | | ++++ |
| 821/822 | P470Q/S541R/ I542L/F543A/ N565A/K645S/ Q647W | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/S541R/I542L/ F543A/A545I/N565A/S581L/ Y582R/E620V/A639T/K645S/ A646V/Q647W | | | +++ |
| 823/824 | R205L/P470Q/ D567R/L568R/ K645S | S205L/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/D567R/ L568R/S581L/Y582R/E620V/ A639T/K645S/A646V | | | +++ |

TABLE 3.16-continued

Protease Activity Relative to SEQ ID NO: 756[1]

| SEQ ID NO: (nt/aa) | Amino Acid Differences (Relative to SEQ ID NO: 756) | Amino Acid Differences (Relative to SEQ ID NO: 2)[2] | Unchallenged Activity Improvement UC (Relative to SEQ ID NO: 756) | Autolysis Stability Improvement (Relative to SEQ ID NO: 756) | Pepsin Pre-Incubation Improvement (Relative to SEQ ID NO: 756) |
|---|---|---|---|---|---|
| 825/826 | R205L/P470Q/ I545L/L568R/ K645S/Q647W/ Q664R | S205L/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545L/L568R/ S581L/Y582R/E620V/A639T/ K645S/A646V/Q647W/Q664R | | | +++ |
| 827/828 | N344V/P470Q/ E489D/P539L/ I542L/K645S/ Q647W/Q664R | S205R/M236V/Q258K/E261D/ L300F/A301V/A308E/N339W/ L342R/N344V/V346K/V347F/ S370C/A408V/S439M/V442L/ P446R/A449L/N450R/A468S/ P470Q/Q490E/Q505A/R514H/ Q536W/E537P/P539L/I542L/ A545I/S581L/Y582R/E620V/ A639T/K645S/A646V/Q647W/ Q664R | | | +++ |
| 829/830 | N344V/P470Q/ E489D/D567R/ L568R | S205R/M236V/Q258K/E261D/ L300F/A301V/A308E/N339W/ L342R/N344V/V346K/V347F/ S370C/A408V/S439M/V442L/ P446R/A449L/N450R/A468S/ P470Q/Q490E/Q505A/R514H/ Q536W/E537P/A545I/D567R/ L568R/S581L/Y582R/E620V/ A639T/A646V | | | +++ |
| 831/832 | N344V/P470Q/ Q647W | S205R/M236V/Q258K/E261D/ L300F/A301V/A308E/N339W/ L342R/N344V/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q647W | | | +++ |
| 833/834 | N344V/P470Q/ L568R | S205R/M236V/Q258K/E261D/ L300F/A301V/A308E/N339W/ L342R/N344V/V346K/V347F/ S370C/A408V/S439M/V442L/ P446R/A449L/N450R/A468S/ P470Q/D489E/Q490E/Q505A/ R514H/Q536W/E537P/A545I/ L568R/S581L/Y582R/E620V/ A639T/A646V | | | +++ |
| 835/836 | N344V/L355C/ P470Q/L568R/ K645S/Q647W | S205R/M236V/Q258K/E261D/ L300F/A301V/A308E/N339W/ L342R/N344V/V346K/V347F/ L355C/S370C/A408V/S439M/ V442L/P446R/A449L/N450R/ A468S/P470Q/D489E/Q490E/ Q505A/R514H/Q536W/E537P/ A545I/L568R/S581L/Y582R/ E620V/A639T/K645S/A646V/ Q647W | | | ++ |

[1] All activities were determined relative to the reference polypeptide of SEQ ID NO: 756. Levels of increased activity are defined as follows: "+" = 0.9 to 1.1; "++" > 1.1; "+++" > 1.5; and "++++" > 3.
[2] Amino Acid Differences does not include Histidine tag at C-terminus

TABLE 3.17

| | | | Protease Activity Relative to SEQ ID NO: 756[1] | | |
|---|---|---|---|---|---|
| SEQ ID NO: (nt/aa) | Amino Acid Differences (Relative to SEQ ID NO: 756) | Amino Acid Differences (Relative to SEQ ID NO: 2)[2] | Unchallenged Activity Improvement (Relative to SEQ ID NO: 756) | Autolysis Stability Improvement (Relative to SEQ ID NO: 756) | Pepsin Pre-Incubation Improvement (Relative to SEQ ID NO: 756) |
| 755/756 | | S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | + | + | + |
| 837/838 | R9K/A63E/ A93E/M107K | R9K/A63E/A93E/M107K/ S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | | ++ |
| 839/840 | T17A/N29S/ I32A/T34M/ T36D/A63E | T17A/N29S/I32A/T34M/ T36D/A63E/S205R/M236V/ Q258K/E261D/L300F/A301V/ A308E/N339W/L342R/V346K/ V347F/S370C/A408V/S439M/ V442L/P446R/A449L/N450R/ A468S/D489E/Q490E/Q505A/ R514H/Q536W/E537P/A545I/ S581L/Y582R/E620V/A639T/ A646V | | | ++ |
| 841/842 | I32A/S43P/ A93E | I32A/S43P/A93E/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | | | +++ |
| 843/844 | E35G/A93E/ G145E | E35G/A93E/G145E/S205R/ M236V/Q258K/E261D/L300F/ A301V/A308E/N339W/L342R/ V346K/V347F/S370C/A408V/ S439M/V442L/P446R/A449L/ N450R/A468S/D489E/Q490E/ Q505A/R514H/Q536W/E537P/ A545I/S581L/Y582R/E620V/ A639T/A646V | | | ++ |
| 845/846 | R9K/S43P/ A93E/G127S | R9K/S43P/A93E/G127S/ S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | + | +++ |
| 847/848 | R9K/T17A/ I32A/T34M/ T36D/N50S/ N77D/M107K/ G127S | R9K/T17A/I32A/T34M/ T36D/N50S/N77D/M107K/ G127S/S205R/M236V/Q258K/ E261D/L300F/A301V/A308E/ N339W/L342R/V346K/V347F/ S370C/A408V/S439M/V442L/ P446R/A449L/N450R/A468S/ D489E/Q490E/Q505A/R514H/ Q536W/E537P/A545I/S581L/ Y582R/E620V/A639T/A646V | | | +++ |

TABLE 3.17-continued

Protease Activity Relative to SEQ ID NO: 756[1]

| SEQ ID NO: (nt/aa) | Amino Acid Differences (Relative to SEQ ID NO: 756) | Amino Acid Differences (Relative to SEQ ID NO: 2)[2] | Unchallenged Activity Improvement (Relative to SEQ ID NO: 756) | Autolysis Stability Improvement (Relative to SEQ ID NO: 756) | Pepsin Pre-Incubation Improvement (Relative to SEQ ID NO: 756) |
|---|---|---|---|---|---|
| 849/850 | R205L/R263V/ E489D/Q647W | S205L/M236V/Q258K/E261D/ R263V/L300F/A301V/A308E/ N339W/L342R/V346K/V347F/ S370C/A408V/S439M/V442L/ P446R/A449L/N450R/A468S/ Q490E/Q505A/R514H/Q536W/ E537P/A545I/S581L/Y582R/ E620V/A639T/A646V/Q647W | | +++ | + |
| 851/852 | N29S/T34M/ E35G/N77D | N29S/T34M/E35G/N77D/ S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | ++ | +++ |
| 853/854 | R9K/T17A/ A63E/N77D | R9K/T17A/A63E/N77D/ S205R/M236V/Q258K/E261D/ L300F/A301V/A308E/N339W/ L342R/V346K/V347F/S370C/ A408V/S439M/V442L/P446R/ A449L/N450R/A468S/D489E/ Q490E/Q505A/R514H/Q536W/ E537P/A545I/S581L/Y582R/ E620V/A639T/A646V | | + | ++ |

[1]All activities were determined relative to the reference polypeptide of SEQ ID NO: 756. Levels of increased activity are defined as follows: "+" = 0.9 to 1.1; "++" > 1.1; "+++" > 1.5; and "++++" > 3.
[2]Amino Acid Differences does not include Histidine tag at C-terminus Based on the results shown in Table 3.16, SEQ ID NO: 812 was chosen as the next parent sequence for the next iteration of protein optimization. Beneficial mutations identified from the results in Table 3.16 were recombined into this backbone. Additionally, variants were also constructed using SEQ ID NO: 812, with saturation mutagenesis at different positions. The variants generated were screened in singlicate for protease activity at pH 6, and after a pre-incubation at pH 2.5, with 1.5 mg/mL pepsin for 1 hr as described in Example 2. The results (relative to those obtained for SEQ ID NO: 812) are provided in Table 3.18. In some additional experiments, some of the protease variants were purified and assayed in triplicate for protease activity at pH 6, after a pre-incubation at pH 3 with 1.5 mg/mL pepsin for 1 hr, and for autolysis stability by measuring the protease activity after 1 day of incubation at room temperature, as described in Example 2. The results (relative to the results obtained for SEQ ID NO: 812) are provided in Table 3.18. In some additional experiments, some of the variants were purified and assayed in triplicate for protease activity at pH 6, after a pre-incubation at pH 3.5, with 1.5 mg/mL pepsin for 1 hr, and for autolysis stability by measuring the protease activity after 1 day of incubation at room temperature, as described in Example 2. The results (relative to the results obtained for SEQ ID NO: 812) are provided in Table 3.19 and Table 3.20.

TABLE 3.18

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Pepsin Pre-Incubation Improvement (Relative to SEQ ID NO: 812) |
|---|---|---|---|
| 855/856 | V646I | S205R/M236V/Q258K/E261D/L300F/A301V/A308E/N339W/ L342R/V346K/V347F/S370C/A408V/S439M/V442L/P446R/ A449L/N450R/A468S/P470Q/D489E/Q490E/Q505A/R514H/ Q536W/E537P/A545I/S581L/Y582R/E620V/A639T/A646I/ Q664R | + |
| 857/858 | V646M | S205R/M236V/Q258K/E261D/L300F/A301V/A308E/N339W/ L342R/V346K/V347F/S370C/A408V/S439M/V442L/P446R/ A449L/N450R/A468S/P470Q/D489E/Q490E/Q505A/R514H/ Q536W/E537P/A545I/S581L/Y582R/E620V/A639T/A646M/ Q664R | ++ |

TABLE 3.18-continued

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Pepsin Pre-Incubation Improvement (Relative to SEQ ID NO: 812) |
|---|---|---|---|
| 859/860 | L442V | S205R/M236V/Q258K/E261D/L300F/A301V/A308E/N339W/ L342R/V346K/V347F/S370C/A408V/S439M/P446R/A449L/ N450R/A468S/P470Q/D489E/Q490E/Q505A/R514H/Q536W/ E537P/A545I/S581L/Y582R/E620V/A639T/A646V/Q664R | ++ |
| 861/862 | A454S | S205R/M236V/Q258K/E261D/L300F/A301V/A308E/N339W/ L342R/V346K/V347F/S370C/A408V/S439M/V442L/P446R/ A449L/N450R/A454S/A468S/P470Q/D489E/Q490E/Q505A/ R514H/Q536W/E537P/A545I/S581L/Y582R/E620V/A639T/ A646V/Q664R | ++ |
| 863/864 | V646R | S205R/M236V/Q258K/E261D/L300F/A301V/A308E/N339W/ L342R/V346K/V347F/S370C/A408V/S439M/V442L/P446R/ A449L/N450R/A468S/P470Q/D489E/Q490E/Q505A/R514H/ Q536W/E537P/A545I/S581L/Y582R/E620V/A639T/A646R/ Q664R | +4- |
| 865/866 | A454L | S205R/M236V/Q258K/E261D/L300F/A301V/A308E/N339W/ L342R/V346K/V347F/S370C/A408V/S439M/V442L/P446R/ A449L/N450R7A454L/A468S/P470Q/D489E/Q490E/Q505A/ R514H/Q536W/E537P/A545I/S581L/Y582R/E620V/A639T/ A646V/Q664R | ++ |
| 867/868 | A454M | S205R/M236V/Q258K/E261D/L300F/A301V/A308E/N339W/ L342R/V346K/V347F/S370C/A408V/S439M/V442L/P446R/ A449L/N450R/A454M/A468S/P470Q/D489E/Q490E/Q505A/ R514H/Q536W/E537P/A545I/S581L/Y582R/E620V/A639T/ A646V/Q664R | ++ |
| 869/870 | G265R | S205R/M236V/Q258K/E261D/G265R/L300F/A301V/A308E/ N339W/L342R/V346K/V347F/S370C/A408V/S439M/V442L/ P446R/A449L/N450R/A468S/P470Q/D489E/Q490E/Q505A/ R514H/Q536W/E537P/A545I/S581L/Y582R/E620V/A639T/ A646V/Q664R | ++ |
| 871/872 | D649Y | S205R/M236V/Q258K/E261D/L300F/A301V/A308E/N339W/ L342R/V346K/V347F/S370C/A408V/S439M/V442L/P446R/ A449L/N450R/A468S/P470Q/D489E/Q490E/Q505A/R514H/ Q536W/E537P/A545I/S581L/Y582R/E620V/A639T/A646V/ D649Y/Q664R | ++ |
| 873/874 | V334I | S205R/M236V/Q258K/E261D/L300F/A301V/A308E/V334I/ N339W/L342R/V346K/V347F/S370C/A408V/S439M/V442L/ P446R/A449L/N450R/A468S/P470Q/D489E/Q490E/Q505A/ R514H/Q536W/E537P/A545I/S581L/Y582R/E620V/A639T/ A646V/Q664R | ++ |
| 875/876 | N266E | S205R/M236V/Q258K/E261D/N266E/L300F/A301V/A308E/ N339W/L342R/V346K/V347F/S370C/A408V/S439M/V442L/ P446R/A449L/N450R/A468S/P470Q/D489E/Q490E/Q505A/ R514H/Q536W/E537P/A545I/S581L/Y582R/E620V/A639T/ A646V/Q664R | ++ |
| 877/878 | K189P | K189P/S205R/M236V/Q258K/E261D/L300F/A301V/A308E/ N339W/L342R/V346K/V347F/S370C/A408V/S439M/V442L/ P446R/A449L/N450R/A468S/P470Q/D489E/Q490E/Q505A/ R514H/Q536W/E537P/A545I/S581L/Y582R/E620V/A639T/ A646V/Q664R | ++ |
| 879/880 | N266G | S205R/M236V/Q258K/E261D/N266G/L300F/A301V/A308E/ N339W/L342R/V346K/V347F/S370C/A408V/S439M/V442L/ P446R/A449L/N450R/A468S/P470Q/D489E/Q490E/Q505A/ R514H/Q536W/E537P/A545I/S581L/Y582R/E620V/A639T/ A646V/Q664R | ++ |
| 881/882 | K189A | K189A/S205R/M236V/Q258K/E261D/L300F/A301V/A308E/ N339W/L342R/V346K/V347F/S370C/A408V/S439M/V442L/ P446R/A449L/N450R/A468S/P470Q/D489E/Q490E/Q505A/ R514H/Q536W/E537P/A545I/S581L/Y582R/E620V/A639T/ A646V/Q664R | ++ |
| 883/884 | D649T | S205R/M236V/Q258K/E261D/L300F/A301V/A308E/N339W/ L342R/V346K/V347F/S370C/A408V/S439M/V442L/P446R/ A449L/N450R/A468S/P470Q/D489E/Q490E/Q505A/R514H/ Q536W/E537P/A545I/S581L/Y582R/E620V/A639T/A646V/ D649T/Q664R | ++ |

TABLE 3.18-continued

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Pepsin Pre-Incubation Improvement (Relative to SEQ ID NO: 812) |
|---|---|---|---|
| 885/886 | N188W | N188W/S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/E620V/A639T/A646V/Q664R | ++ |

[1]All activities were determined relative to the reference polypeptide of SEQ ID NO: 812. Levels of increased activity are defined as follows: "+" = 0.9 to 1.1; "++" > 1.1; "+++" > 1.5; and "++++" > 3.
[2]Amino Acid Differences does not include Histidine tag at C-terminus

TABLE 3.19

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2) | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 887/888 | K189I | K189I/S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/E620V/A639T/A646V/Q664R | | | ++ |
| 889/890 | V546L | S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/V546L/S581L/Y582R/E620V/A639T/A646V/Q664R | | ++ | ++ |
| 891/892 | N266W | S205R/M236V/Q258K/E261D/N266W/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/E620V/A639T/A646V/Q664R | + | + | ++ |
| 893/894 | V594A | S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/V594A/E620V/A639T/A646V/Q664R | ++ | | ++ |
| 895/896 | V646L | S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/E620V/A639T/A646L/Q664R | ++ | + | ++ |

TABLE 3.19-continued

| | | Protease Activity Relative to SEQ ID NO: 812[1] | | |
|---|---|---|---|---|
| SEQ ID NO: (nt/aa) | Amino Acid Differences (Relative to SEQ ID NO: 812) | Amino Acid Differences (Relative to SEQ ID NO: 2) | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
| 897/898 | N266L/ N283K | S205R/M236V/Q258K/E261D/ N266L/N283K/L300F/A301V/ A308E/N339W/L342R/V346K/ V347F/S370C/A408V/S439M/ V442L/P446R/A449L/N450R/ A468S/P470Q/D489E/Q490E/ Q505A/R514H/Q536W/E537P/ A545I/S581L/Y582R/E620V/ A639T/A646V/Q664R | ++ | | ++ |
| 899/900 | N266Y | S205R/M236V/Q258K/E261D/ N266Y/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | ++ | ++ |
| 901/902 | N266V | S205R/M236V/Q258K/E261D/ N266V/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | +++ | ++ |
| 903/904 | N266L | S205R/M236V/Q258K/E261D/ N266L/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | | ++ |
| 905/906 | N266M | S205R/M236V/Q258K/E261D/ N266M/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | +++ | | +++ |
| 907/908 | N266S | S205R/M236V/Q258K/E261D/ N266S/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | +++ | ++ | +++ |
| 909/910 | N266A | S205R/M236V/Q258K/E261D/ N266A/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | +++ | +++ | +++ |

[1]All activities were determined relative to the reference polypeptide of SEQ ID NO: 812. Levels of increased activity are defined as follows: "+" = 0.9 to 1.1; "++" > 1.1; "+++" > 1.5; and "++++" > 3.
[2]Antino Acid Differences does not include Histidine tag at C-terminus

TABLE 3.20

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 911/912 | T558E/D577V/V594A | S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/T558E/D577V/S581L/Y582R/V594A/E620V/A639T/A646V/Q664R | | | ++ |
| 913/914 | R263I/Q470P/L568R | S205R/M236V/Q258K/E261D/R263I/L300F/A301V/A308E/N339W/L342R/V346K/V347F/S370C/A408V/S439M/V442L/P446R/A449L/N450R/A468S/D489E/Q490E/Q505A/R514H/Q536W/E537P/A545I/L568R/S581L/Y582R/E620V/A639T/A646V/Q664R | ++++ | ++ | ++ |
| 799/800 | Q470P/I542L/F543A/R664Q | S205R/M236V/Q258K/E261D/L300F/A301V/A308E/N339W/L342R/V346K/V347F/S370C/A408V/S439M/V442L/P446R/A449L/N450R/A468S/D489E/Q490E/Q505A/R514H/Q536W/E537P/I542L/F543A/A545I/S581L/Y582R/E620V/A639T/A646V | ++++ | +++ | ++ |
| 915/916 | N266R | S205R/M236V/Q258K/E261D/N266R/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/E620V/A639T/A646V/Q664R | +++ | | |

[1]All activities were determined relative to the reference polypeptide of SEQ ID NO: 812. Levels of increased activity are defined as follows: "+" - 0.9 to 1.1; "++" > 1.1; "+++" > 1.5; and "++++" > 3.
[2]Amino Acid Differences does not include Histidine tag at C-terminus Beneficial mutations observed for the different conditions tested and shown in the above Tables, were recombined into SEQ ID NO: 812. Additionally, variants were also constructed using SEQ ID NO: 812, with mutagenesis at different positions, homolog diversity, and also for removal of arginine and lysine residues. The variants were purified and assayed in triplicate for protease activity at pH 6, after a pre-incubation at pH 3 with 1.5 mg/mL pepsin for 1 hr, and for autolysis stability by measuring the protease activity after 1 day of incubation at room temperature, as described in Example 2. The results (relative to the results obtained for SEQ ID NO: 812) are provided in Table 3.21.

TABLE 3.21

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 917/918 | N29F | N29F/S205R/M236V/Q258K/E261D/L300F/A301V/A308E/N339W/L342R/V346K/V347F/S370C/A408V/S439M/V442L/P446R/A449L/N450R/A468S/P470Q/D489E/Q490E/Q505A/R514H/Q536W/E537P/A545I/S581L/Y582R/E620V/A639T/A646V/Q664R | +++ | | |

TABLE 3.21-continued

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 919/920 | E35G/K346V/ K406R/A511S/ L581S/R582Y/ R664Q | E35G/S205R/M236V/Q258K/ E261D/L300F/A301V/A308E/ N339W/L342R/V347F/S370C/ K406R/A408V/S439M/V442L/ P446R/A449L/N450R/A468S/ P470Q/D489E/Q490E/Q505A/ A511S/R514H/Q536W/E537P/ A545I/E620V/A639T/A646V | +++ | | ++ |
| 921/922 | I187G | I187G/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | +++ | | ++ |
| 923/924 | N29G | N29G/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | +++ | ++ | |
| 925/926 | R654C | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ R654C/Q664R | +++ | ++ | + |
| 927/928 | K406R/R664Q | S205R/M236V/Q258K/E261D/ L300F/A301V/A308E/N339W/ L342R/V346K/V347F/S370C/ K406R/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V | +++ | | ++ |
| 929/930 | R582S | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582S/E620V/A639T/A646V/ Q664R | +++ | +++ | ++ |
| 931/932 | E35D/A511S | E35D/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ A511S/R514H/Q536W/E537P/ A545I/S581L/Y582R/E620V/ A639T/A646V/Q664R | +++ | | ++ |
| 933/934 | N29S/N50S/ A511S/P539L/ L581S | N29S/N50S/S205R/M236V/ Q258K/E261D/L300F/A301V/ A308E/N339W/L342R/V346K/ V347F/S370C/A408V/S439M/ V442L/P446R/A449L/N450R/ A468S/P470Q/D489E/Q490E/ Q505A/A511S/R514H/Q536W/ E537P/P539L/A545I/Y582R/ E620V/A639T/A646V/Q664R | +++ | | ++ |

TABLE 3.21-continued

| | | | Protease Activity Relative to SEQ ID NO: 812[1] | | |
|---|---|---|---|---|---|
| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
| 935/936 | E35G/N50S/ R205S/K406R/ A511S/L581S | E35G/N50S/M236V/Q258K/ E261D/L300F/A301V/A308E/ N339W/L342R/V346K/V347F/ S370C/K406R/A408V/S439M/ V442L/P446R/A449L/N450R/ A468S/P470Q/D489E/Q490E/ Q505A/A511S/R514H/Q536W/ E537P/A545I/Y582R/E620V/ A639T/A646V/Q664R | ++ | | + |
| 937/938 | R294A/R441A/ K527A | S205R/M236V/Q258K/E261D/ R294A/L300F/A301V/A308E/ N339W/L342R/V346K/V347F/ S370C/A408V/S439M/R441A/ V442L/P446R/A449L/N450R/ A468S/P470Q/D489E/Q490E/ Q505A/R514H/K527A/Q536W/ E537P/A545I/S581L/Y582R/ E620V/A639T/A646V/Q664R | ++ | +++ | + |
| 939/940 | R582Y | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ E620V/A639T/A646V/Q664R | ++ | + | + |
| 941/942 | E35G/P539L | E35G/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/P539L/ A545I/S581L/Y582R/E620V/ A639T/A646V/Q664R | ++ | | ++ |
| 943/944 | R257L | S205R/M236V/R257L/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | | |
| 945/946 | N29S/E35G | N29S/E35G/S205R/M236V/ Q258K/E261D/L300F/A301V/ A308E/N339W/L342R/V346K/ V347F/S370C/A408V/S439M/ V442L/P446R/A449L/N450R/ A468S/P470Q/D489E/Q490E/ Q505A/R514H/Q536W/E537P/ A545I/S581L/Y582R/E620V/ A639T/A646V/Q664R | ++ | | ++ |
| 947/948 | E35G/A511S | E35G/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ A511S/R514H/Q536W/E537P/ A545I/S581L/Y582R/E620V/ A639T/A646V/Q664R | ++ | ++ | ++ |
| 949/950 | K429L/K652T | S205R/M236V/Q258K/E261D/ L300F/A301V/A308E/N339W/ L342R/V346K/V347F/S370C/ A408V/K429L/S439M/V442L/ P446R/A449L/N450R/A468S/ P470Q/D489E/Q490E/Q505A/ R514H/Q536W/E537P/A545I/ S581L/Y582R/E620V/A639T/ A646V/K652T/Q664R | ++ | | + |

TABLE 3.21-continued

| | | | Protease Activity Relative to SEQ ID NO: 812[1] | | |
|---|---|---|---|---|---|
| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
| 951/952 | R582G | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582G/E620V/A639T/A646V/ Q664R | ++ | ++ | ++ |
| 953/954 | A147T | A147T/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | | ++ |
| 955/956 | N188T | N188T/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | | ++ |
| 957/958 | K652T | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ K652T/Q664R | ++ | + | ++ |
| 959/960 | E35G/K346V | E35G/S205R/M236V/Q258K/ E261D/L300F/A301V/A308E/ N339W/L342R/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664R | ++ | ++ | ++ |
| 961/962 | K615Q | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/K615Q/E620V/A639T/ A646V/Q664R | ++ | + | + |
| 963/964 | I545V | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545V/S581L/ Y582R/E620V/A639T/A646V/ Q664R | ++ | ++ | ++ |
| 965/966 | K652Y | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ | ++ | ++ | + |

TABLE 3.21-continued

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 967/968 | R294A | S205R/M236V/Q258K/E261D/ R294A/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581E/Y582R/E620V/A639T/ A646V/K652Y/Q664R | ++ | ++ | + |
| 969/970 | K652Q | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581E/ Y582R/E620V/A639T/A646V/ K652Q/Q664R | ++ | + | + |
| 971/972 | K652L | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ K652L/Q664R | ++ | ++ | + |
| 973/974 | E35G/R205S/ A511S | E35G/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/A511S/ R514H/Q536W/E537P/A545I/ S581L/Y582R/E620V/A639T/ A646V/Q664R | ++ | ++ | + |
| 975/976 | R342F | S205R/M236V/Q258K/E261D/ L300F/A301V/A308E/N339W/ L342F/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A39T/A646V/ Q664R | ++ | +++ | ++ |
| 977/978 | R526V | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ R526V/Q536W/E537P/A545I/ S581L/Y582R/E620V/A639T/ A646V/Q664R | ++ | ++ | + |
| 979/980 | L133V | L133V/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | | + |

TABLE 3.21-continued

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 981/982 | R664W | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664W | ++ | ++ | ++ |
| 983/984 | R441A | S205R/M236V/Q258K/E261D/ L300F/A301V/A308E/N339W/ L342R/V346K/V347F/S370C/ A408V/S439M/R441A/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | ++ | + |
| 985/986 | E308A/R342L/ A511S/L581S/ R582Y | S205R/M236V/Q258K/E261D/ L300F/A301V/N339W/V346K/ V347F/S370C/A408V/S439M/ V442L/P446R/A449L/N450R/ A468S/P470Q/D489E/Q490E/ Q505A/A511S/R514H/Q536W/ E537P/A545I/E620V/A639T/ A646V/Q664R | ++ | ++ | ++ |
| 987/988 | T639I | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639I/A646V/ Q664R | ++ | ++ | ++ |
| 989/990 | E35G | E35G/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | + | ++ |
| 991/992 | R648Q | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ R648Q/Q664R | ++ | ++ | + |
| 993/994 | R648V | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ R648V/Q664R | ++ | ++ | ++ |
| 995/996 | K346V | S205R/M236V/Q258K/E261D/ L300F/A301V/A308E/N339W/ L342R/V347F/S370C/A408V/ S439M/V442L/P446R/A449L/ N450R/A468S/P470Q/D489E/ Q490E/Q505A/R514H/Q536W/ E537P/A545I/S581L/Y582R/ E620V/A639T/A646V/Q664R | ++ | ++ | + |

TABLE 3.21-continued

| | | | Protease Activity Relative to SEQ ID NO: 812[1] | | |
|---|---|---|---|---|---|
| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
| 997/998 | A511S | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/A511S/ R514H/Q536W/E537P/A545I/ S581L/Y582R/E620V/A639T/ A646V/Q664R | ++ | + | + |
| 999/1000 | R664G | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664G | ++ | ++ | ++ |
| 1001/1002 | K645G | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/K645G/ A646V/Q664R | ++ | ++ | ++ |
| 1003/1004 | I132T | I132T/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | | ++ |
| 1005/1006 | K527R | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ K527R/Q536W/E537P/A545I/ S581L/Y582R/E620V/A639T/ A646V/Q664R | ++ | ++ | + |
| 1007/1008 | R482V | S205R/M236V/Q258K/E261D/ L300F/A301V/A308E/N339W/ L342R/V346K/V347F/S370C/ A408V/S439M/V442L/P446R/ A449L/N450R/A468S/P470Q/ R482V/D489E/Q490E/Q505A/ R514H/Q536W/E537P/A545I/ S581L/Y582R/E620V/A639T/ A646V/Q664R | ++ | | ++ |
| 1009/1010 | A398G | S205R/M236V/Q258K/E261D/ L300F/A301V/A308E/N339W/ L342R/V346K/V347F/S370C/ A398G/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | ++ | + | + |
| 1011/1012 | N29S/E35G/ R342L/L581S/ R582Y/R664Q | N29S/E35G/S205R/M236V/ Q258K/E261D/L300F/A301V/ A308E/N339W/V346K/V347F/ S370C/A408V/S439M/V442L/ P446R/A449L/N450R/A468S/ P470Q/D489E/Q490E/Q505A/ R514H/Q536W/E537P/A545I/ E620V/A639T/A646V | + | +++ | ++ |

TABLE 3.21-continued

| | | Protease Activity Relative to SEQ ID NO: 812[1] | | |
|---|---|---|---|---|
| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 1013/1014 | V646G | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646G/ Q664R | + | + | + |
| 1015/1016 | A505F | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505F/R514H/ Q536W/E537P/A545I/S581L/ Y582R/E620V/A639T/A646V/ Q664R | + | | ++ |
| 1017/1018 | R664V | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664V | + | + | ++ |
| 1019/1020 | V620E | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/A639T/A646V/Q664R | + | ++ | + |
| 1021/1022 | K645E | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/K645E/ A646V/Q664R | + | | + |
| 1023/1024 | N50S/R342L | N50S/S205R/M236V/Q258K/ E261D/L300F/A301V/A308E/ N339W/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664R | + | +++ | ++ |
| 1025/1026 | L581S | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/Y582R/ E620V/A639T/A646V/Q664R | + | ++ | ++ |
| 1027/1028 | V646R | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646R/ Q664R | + | ++ | ++ |

TABLE 3.21-continued

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 1029/1030 | E35G/R342L/ K346V/A511S/ P539L/L581S | E35G/S205R/M236V/Q258K/ E261D/L300F/A301V/A308E/ N339W/V347F/S370C/A408V/ S439M/V442L/P446R/A449L/ N450R/A468S/P470Q/D489E/ Q490E/Q505A/A511S/R514H/ Q536W/E537P/P539L/A545I/ Y582R/E620V/A639T/A646V/ Q664R | + | +++ | +++ |
| 1031/1032 | R446P/K652T | S205R/M236V/Q258K/E261D/ L300F/A301V/A308E/N339W/ L342R/V346K/V347F/S370C/ A408V/S439M/V442L/A449L/ N450R/A468S/P470Q/D489E/ Q490E/Q505A/R514H/Q536W/ E537P/A545I/S581L/Y582R/ E620V/A639T/A646V/K652T/ Q664R | + | ++ | + |
| 1033/1034 | L581A | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581A/ Y582R/E620V/A639T/A646V/ Q664R | + | + | + |
| 1035/1036 | R263S | S205R/M236V/Q258K/E261D/ R263S/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | + | + | + |
| 1037/1038 | K258H | S205R/M236V/Q258H/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664R | + | ++ | ++ |
| 1039/1040 | T639E | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639E/A646V/ Q664R | + | ++ | |
| 1041/1042 | K258N | S205R/M236V/Q258N/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/A646V/ Q664R | + | + | ++ |

TABLE 3.21-continued

| | | | Protease Activity Relative to SEQ ID NO: 812[1] | | |
|---|---|---|---|---|---|
| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
| 1043/1044 | R441V | S205R/M236V/Q258K/E261D/ L300F/A301V/A308E/N339W/ L342R/V346K/V347F/S370C/ A408V/S439M/R441V/V442L/ P446R/A449L/N450R/A468S/ P470Q/D489E/Q490E/Q505A/ R514H/Q536W/E537P/A545I/ S581L/Y582R/E620V/A639T/ A646V/Q664R | + | ++ | + |
| 1045/1046 | A505M | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505M/R514H/ Q536W/E537P/A545I/S581L/ Y582R/E620V/A639T/A646V/ Q664R | + | | |
| 1047/1048 | E143H | E143H/S205R/M236V/Q258K/ E261D/L300F/A301V/A308E/ N339W/L342R/V346K/V347F/ S370C/A408V/S439M/V442L/ P446R/A449L/N450R/A468S/ P470Q/D489E/Q490E/Q505A/ R514H/Q536W/E537P/A545I/ S581L/Y582R/E620V/A639T/ A646V/Q664R | + | ++ | ++ |
| 1049/1050 | W536H | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536H/E537P/A545I/S581L/ Y582R/E620V/A639T/A646V/ Q664R | + | + | + |
| 1051/1052 | K645W | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536W/E537P/A545I/S581L/ Y582R/E620V/A639T/K645W/ A646V/Q664R | + | ++ | + |
| 1053/1054 | K527D | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ K527D/Q536W/E537P/A545I/ S581L/Y582R/E620V/A639T/ A646V/Q664R | + | + | + |
| 1055/1056 | W536R | S205R/M236V/Q258K/E261D/ L300F/A301V/A308E/N339W/ L342R/V346K/V347F/S370C/ A408V/S439M/V442L/P446R/ A449L/N450R/A468S/P470Q/ D489E/Q490E/Q505A/R514H/ Q536R/E537P/A545I/S581L/ Y582R/E620V/A639T/A646V/ Q664R | | | + |

TABLE 3.21-continued

Protease Activity Relative to SEQ ID NO: 812[1]

| SEQ ID NO: (nt/aa) | Amino Acid Differences (Relative to SEQ ID NO: 812) | Amino Acid Differences (Relative to SEQ ID NO: 2)[2] | Unchallenged Activity Improvement (Relative to SEQ ID NO: 812) | Autolysis Stability Improvement (Relative to SEQ ID NO: 812) | Pepsin Pre-Incubation Improvement (Relative to SEQ ID NO: 812) |
|---|---|---|---|---|---|
| 1057/1058 | R441A/R446P/R526L | S205R/M236V/Q258K/E261D/L300F/A301V/A308E/N339W/L342R/V346K/V347F/S370C/A408V/S439M/R441A/V442L/A449L/N450R/A468S/P470Q/D489E/Q490E/Q505A/R514H/R526L/Q536W/E537P/A545I/S581L/Y582R/E620V/A639T/A646V/Q664R | | ++ | |

[1]All activities were determined relative to the reference polypeptide of SEQ ID NO: 812. Levels of increased activity are defined as follows: "+" = 0.9 to 1.1; "++" > 1.1;"+++" > 1.5; and "++++" > 3.
[2]Amino Acid Differences does not include Histidine tag at C-terminus Based on the results shown in Table 3.21, SEQ ID NO: 1030 was chosen as the next parent sequence for the next iteration of protein optimization. Beneficial mutations identified based on the results shown in Table 3.21 were recombined into this backbone. Additionally, variants were also constructed on SEQ ID NO: 1030, with mutagenesis at different positions. The variants were purified and assayed in triplicate for protease activity at pH 6, after a pre-incubation at pH 3, with 1.5 mg/mL pepsin for 1 hr, and also for autolysis stability by measuring protease activity after incubation for 24 hours at 37° C., as described in Example 2. The results (relative to those obtained for SEQ ID NO: 1030) are provided in Table 3.22.

TABLE 3.22

Protease Activity Relative to SEQ ID NO: 1030[1]

| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
|---|---|---|---|---|---|
| 1059/1060 | D237E/K527V | E35G/S205R/M236V/D237E/Q258K/E261D/L300F/A301V/A308E/N339W/V347F/S370C/A408V/S439M/V442L/P446R/A449L/N450R/A468S/P470Q/D489E/Q490E/Q505A/A511S/R514H/K527V/Q536W/E537P/P539L/A545I/Y582R/E620V/A639T/A646V/Q664R | + | ++ | ++ |
| 1061/1062 | E143H/N266A/R441V/V620E/T639V | E35G/E143H/S205R/M236V/Q258K/E261D/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/A639V/A646V/Q664R | ++ | ++ | ++ |
| 1063/1064 | E143H/R263S/N266A/T639V | E35G/E143H/S205R/M236V/Q258K/E261D/R263S/N266A/L300F/A301V/A308E/N339W/V347F/S370C/A408V/S439M/V442L/P446R/A449L/N450R/A468S/P470Q/D489E/Q490E/Q505A/A511S/R514H/Q536W/E537P/P539L/A545I/Y582R/E620V/A639V/A646V/Q664R | ++ | +++ | ++ |
| 1065/1066 | E143Q | E35G/E143Q/S205R/M236V/Q258K/E261D/L300F/A301V/A308E/N339W/V347F/S370C/A408V/S439M/V442L/P446R/A449L/N450R/A468S/P470Q/D489E/Q490E/Q505A/A511S/R514H/Q536W/E537P/P539L/A545I/Y582R/E620V/A639T/A646V/Q664R | + | ++ | ++ |

TABLE 3.22-continued

| | | | Protease Activity Relative to SEQ ID NO: 1030[1] | | |
|---|---|---|---|---|---|
| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
| 1067/1068 | E47G/K570E | E35G/E47G/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ K570E/Y582R/E620V/A639T/ A646V/Q664R | ++ | | |
| 1069/1070 | I495L | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ I495L/Q505A/A511S/R514H/ Q536W/E537P/P539L/A545I/ Y582R/E620V/A639T/A646V/ Q664R | + | +++ | + |
| 1071/1072 | K189Q/D424G | E35G/K189Q/S205R/M236V/ Q258K/E261D/L300F/A301V/ A308E/N339W/V347F/S370C/ A408V/D424G/S439M/V442L/ P446R/A449L/N450R/A468S/ P470Q/D489E/Q490E/Q505A/A511S/ R514H/Q536W/E537P/P539L/ A545I/Y582R/E620V/A639T/ A646V/Q664R | ++ | | |
| 1073/1074 | K258H/L342F/ R582S/R648Q | E35G/S205R/M236V/Q258H/ E261D/L300F/A301V/A308E/ N339W/L342F/V347F/S370C/ A408V/S439M/V442L/P446R/ A449L/N450R/A468S/P470Q/D489E/ Q490E/Q505A/A511S/R514H/ Q536W/E537P/P539L/A545I/ Y582S/E620V/A639T/A646V/ R648Q/Q664R | ++ | | ++ |
| 1075/1076 | K429P | E35G/S205R/M236V/Q258K/ E261D/L300F/A301V/A308E/ N339W/V347F/S370C/A408V/ K429P/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | | ++ | ++ |
| 1077/1078 | K527E | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/K527E/ Q536W/E537P/P539L/A545I/ Y582R/E620V/A639T/A646V/ Q664R | ++ | + | ++ |
| 1079/1080 | K527L | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/K527L/ Q536W/E537P/P539L/A545I/ Y582R/E620V/A639T/A646V/ Q664R | ++ | ++ | + |

TABLE 3.22-continued

Protease Activity Relative to SEQ ID NO: 1030[1]

| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
|---|---|---|---|---|---|
| 1081/1082 | K527M | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/ K527M/Q536W/E537P/P539L/ A545I/Y582R/E620V/A639T/ A646V/Q664R | ++ | ++ | |
| 1083/1084 | K527R | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/K527R/ Q536W/E537P/P539L/A545I/ Y582R/E620V/A639T/A646V/ Q664R | + | ++ | ++ |
| 1085/1086 | K527T | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/K527T/ Q536W/E537P/P539L/A545I/ Y582R/E620V/A639T/A646V/ Q664R | ++ | +++ | + |
| 1087/1088 | K570E | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/K570E/ Y582R/E620V/A639T/A646V/ Q664R | + | ++ | + |
| 1089/1090 | K573T | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/K573T/ Y582R/E620V/A639T/A646V/ Q664R | ++ | ++ | ++ |
| 1091/1092 | K616T | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/Y582R/ K616T/E620V/A639T/A646V/ Q664R | ++ | ++ | ++ |
| 1093/1094 | K632Q | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/Y582R/ E620V/K632Q/A639T/A646V/ Q664R | ++ | + | + |

TABLE 3.22-continued

| | | | Protease Activity Relative to SEQ ID NO: 1030[1] | | |
|---|---|---|---|---|---|
| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
| 1095/1096 | L342F/I545V | E35G/S205R/M236V/Q258K/ E261D/L300F/A301V/A308E/ N339W/L342F/V347F/S370C/ A408V/S439M/V442L/P446R/ A449L/N450R/A468S/P470Q/D489E/ Q490E/Q505A/A511S/R514H/ Q536W/E537P/P539L/A545V/ Y582R/E620V/A639T/A646V/ Q664R | + | | +++ |
| 1097/1098 | L342F/R526V/ R664G | E35G/S205R/M236V/Q258K/ E261D/L300F/A301V/A308E/ N339W/L342F/V347F/S370C/ A408V/S439M/V442L/P446R/ A449L/N450R/A468S/P470Q/D489E/ Q490E/Q505A/A511S/R514H/ R526V/Q536W/E537P/P539L/ A545I/Y582R/E620V/A639T/ A646V/Q664G | + | | ++ |
| 1099/1100 | L342F/R582G | E35G/S205R/M236V/Q258K/ E261D/L300F/A301V/A308E/ N339W/L342F/V347F/S370C/ A408V/S439M/V442L/P446R/ A449L/N450R/A468S/P470Q/D489E/ Q490E/Q505A/A511S/R514H/ Q536W/E537P/P539L/A545I/ Y582G/E620V/A639T/A646V/ Q664R | + | | ++ |
| 1101/1102 | L568P | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/L568P/ Y582R/E620V/A639T/A646V/ Q664R | ++ | +++ | + |
| 1103/1104 | M523V | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/M523V/ Q536W/E537P/P539L/A545I/ Y582R/E620V/A639T/A646V/ Q664R | ++ | ++ | + |
| 1105/1106 | M653I | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/Y582R/ E620V/A639T/A646V/M653I/ Q664R | ++ | ++ | ++ |
| 1107/1108 | N266A/R441V/ V620E/T639V | E35G/S205R/M236V/Q258K/ E261D/N266A/L300F/A301V/ A308E/N339W/V347F/S370C/ A408V/S439M/R441V/V442L/ P446R/A449L/N450R/A468S/ P470Q/D489E/Q490E/Q505A/A511S/ R514H/Q536W/E537P/P539L/ A545I/Y582R/A639V/A646V/ Q664R | ++ | +++ | + |

TABLE 3.22-continued

| | | Protease Activity Relative to SEQ ID NO: 1030[1] | | | |
|---|---|---|---|---|---|
| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
| 1109/1110 | N266A/T639I | E35G/S205R/M236V/Q258K/ E261D/N266A/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639I/A646V/ Q664R | ++ | ++ | + |
| 1111/1112 | N266A/V620E/ T639I | E35G/S205R/M236V/Q258K/ E261D/N266A/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/A639I/A646V/Q664R | ++ | ++ | + |
| 1113/1114 | N266L/R441A | E35G/S205R/M236V/Q258K/ E261D/N266L/L300F/A301V/ A308E/N339W/V347F/S370C/ A408V/S439M/R441A/V442L/ P446R/A449L/N450R/A468S/ P470Q/D489E/Q490E/Q505A/A511S/ R514H/Q536W/E537P/P539L/ A545I/Y582R/E620V/A639T/ A646V/Q664R | + | +++ | |
| 1115/1116 | N29G/E143H/ R263S/N266A/ R441V/T639I | N29G/E35G/E143H/S205R/ M236V/Q258K/E261D/R263S/ N266A/L300F/A301V/A308E/ N339W/V347F/S370C/A408V/ S439M/R441V/V442L/P446R/ A449L/N450R/A468S/P470Q/D489E/ Q490E/Q505A/A511S/R514H/ Q536W/E537P/P539L/A545I/ Y582R/E620V/A639I/A646V/ Q664R | | +++ | + |
| 1117/1118 | N29G/N266A/ R441A | N29G/E35G/S205R/M236V/ Q258K/E261D/N266A/L300F/ A301V/A308E/N339W/V347F/ S370C/A408V/S439M/R441A/ V442L/P446R/A449L/N450R/A468S/ P470Q/D489E/Q490E/Q505A/ A511S/R514H/Q536W/E537P/ P539L/A545I/Y582R/E620V/ A639T/A646V/Q664R | + | +++ | + |
| 1119/1120 | N29G/R263S/ N266A | N29G/E35G/S205R/M236V/ Q258K/E261D/R263S/N266A/ L300F/A301V/A308E/N339W/ V347F/S370C/A408V/S439M/ V442L/P446R/A449L/N450R/A468S/ P470Q/D489E/Q490E/Q505A/ A511S/R514H/Q536W/E537P/ P539L/A545I/Y582R/E620V/ A639T/A646V/Q664R | ++ | +++ | + |
| 1121/1122 | N29G/R263S/ N266L/R441A/ V620E | N29G/E35G/S205R/M236V/ Q258K/E261D/R263S/N266L/ L300F/A301V/A308E/N339W/ V347F/S370C/A408V/S439M/ R441A/V442L/P446R/A449L/ N450R/A468S/P470Q/D489E/Q490E/ Q505A/A511S/R514H/Q536W/ E537P/P539L/A545I/Y582R/ A639T/A646V/Q664R | | +++ | |

TABLE 3.22-continued

| | | | Protease Activity Relative to SEQ ID NO: 1030[1] | | |
|---|---|---|---|---|---|
| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
| 1123/1124 | N29G/R441V/T639V | N29G/E35G/S205R/M236V/Q258K/E261D/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639V/A646V/Q664R | + | +++ | + |
| 1125/1126 | N29S | N29S/E35G/S205R/M236V/Q258K/E261D/L300F/A301V/A308E/N339W/V347F/S370C/A408V/S439M/V442L/P446R/A449L/N450R/A468S/P470Q/D489E/Q490E/Q505A/A511S/R514H/Q536W/E537P/P539L/A545I/Y582R/E620V/A639T/A646V/Q664R | ++ | +++ | + |
| 1127/1128 | P92L | E35G/P92L/S205R/M236V/Q258K/E261D/L300F/A301V/A308E/N339W/V347F/S370C/A408V/S439M/V442L/P446R/A449L/N450R/A468S/P470Q/D489E/Q490E/Q505A/A511S/R514H/Q536W/E537P/P539L/A545I/Y582R/E620V/A639T/A646V/Q664R | + | | ++ |
| 1129/1130 | R135E | E35G/R135E/S205R/M236V/Q258K/E261D/L300F/A301V/A308E/N339W/V347F/S370C/A408V/S439M/V442L/P446R/A449L/N450R/A468S/P470Q/D489E/Q490E/Q505A/A511S/R514H/Q536W/E537P/P539L/A545I/Y582R/E620V/A639T/A646V/Q664R | ++ | ++ | ++ |
| 1131/1132 | R244S | E35G/S205R/M236V/R244S/Q258K/E261D/L300F/A301V/A308E/N339W/V347F/S370C/A408V/S439M/V442L/P446R/A449L/N450R/A468S/P470Q/D489E/Q490E/Q505A/A511S/R514H/Q536W/E537P/P539L/A545I/Y582R/E620V/A639T/A646V/Q664R | ++ | ++ | |
| 1133/1134 | R263S/N266A/R441A | E35G/S205R/M236V/Q258K/E261D/R263S/N266A/L300F/A301V/A308E/N339W/V347F/S370C/A408V/S439M/R441A/V442L/P446R/A449L/N450R/A468S/P470Q/D489E/Q490E/Q505A/A511S/R514H/Q536W/E537P/P539L/A545I/Y582R/E620V/A639T/A646V/Q664R | + | +++ | + |
| 1135/1136 | R263S/N266A/R441V | E35G/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | ++ | +++ | ++ |

TABLE 3.22-continued

| | | | Protease Activity Relative to SEQ ID NO: 1030[1] | | |
|---|---|---|---|---|---|
| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
| 1137/1138 | R263S/N266A/ T639V | E35G/S205R/M236V/Q258K/ E261D/R263S/N266A/L300F/ A301V/A308E/N339W/V347F/ S370C/A408V/S439M/V442L/ P446R/A449L/N450R/A468S/ P470Q/D489E/Q490E/Q505A/A511S/ R514H/Q536W/E537P/P539L/ A545I/Y582R/E620V/A639V/ A646V/Q664R | ++ | +++ | ++ |
| 1139/1140 | R263T | E35G/S205R/M236V/Q258K/ E261D/R263T/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | + | +++ | + |
| 1141/1142 | R267G | E35G/S205R/M236V/Q258K/ E261D/R267G/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | ++ | |
| 1143/1144 | R30G | R30G/E35G/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | + | ++ | ++ |
| 1145/1146 | R37L | E35G/R37L/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | + | |
| 1147/1148 | R441E | E35G/S205R/M236V/Q258K/ E261D/L300F/A301V/A308E/ N339W/V347F/S370C/A408V/ S439M/R441E/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | +++ | |
| 1149/1150 | R482V | E35G/S205R/M236V/Q258K/ E261D/L300F/A301V/A308E/ N339W/V347F/S370C/A408V/ S439M/V442L/P446R/A449L/ N450R/A468S/P470Q/R482V/ D489E/Q490E/Q505A/A511S/R514H/ Q536W/E537P/P539L/A545I/ Y582R/E620V/A639T/A646V/ Q664R | + | ++ | ++ |

TABLE 3.22-continued

Protease Activity Relative to SEQ ID NO: 1030[1]

| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
|---|---|---|---|---|---|
| 1151/1152 | R501Q | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ R501Q/Q505A/A511S/R514H/ Q536W/E537P/P539L/A545I/ Y582R/E620V/A639T/A646V/ Q664R | ++ | ++ | ++ |
| 1153/1154 | R526E | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/R526E/ Q536W/E537P/P539L/A545I/ Y582R/E620V/A639T/A646V/ Q664R | ++ | ++ | + |
| 1155/1156 | R582F | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/Y582F/ E620V/A639T/A646V/Q664R | ++ | ++ | ++ |
| 1157/1158 | R648A | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/Y582R/ E620V/A639T/A646V/R648A/ Q664R | + | ++ | ++ |
| 1159/1160 | R654V | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/Y582R/ E620V/A639T/A646V/R654V/ Q664R | + | ++ | + |
| 1161/1162 | R75N | E35G/R75N/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | ++ | + |
| 1163/1164 | R75S | E35G/R75S/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | +++ | ++ |
| 1165/1166 | R81N | E35G/R81N/S205R/M236V/ Q258K/E261D/L300F/A301V/ A308E/N339W/V347F/S370C/ A408V/S439M/V442L/P446R/ A449L/N450R/A468S/P470Q/ D489E/Q490E/Q505A/A511S/R514H/ Q536W/E537P/P539L/A545I/ Y582R/E620V/A639T/A646V/ Q664R | ++ | + | |

TABLE 3.22-continued

Protease Activity Relative to SEQ ID NO: 1030[1]

| SEQ ID NO: (nt/aa) | Amino Acid Differences (Relative to SEQ ID NO: 1030) | Amino Acid Differences (Relative to SEQ ID NO: 2)[2] | Unchallenged Activity Improvement (Relative to SEQ ID NO: 1030) | Autolysis Stability Improvement (Relative to SEQ ID NO: 1030) | Pepsin Pre-Incubation Improvement (Relative to SEQ ID NO: 1030) |
|---|---|---|---|---|---|
| 1167/1168 | R85L | E35G/R85L/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | + | + |
| 1169/1170 | S168E | E35G/S168E/S205R/M236V/ Q258K/E261D/L300F/A301V/ A308E/N339W/V347F/S370C/ A408V/S439M/V442L/P446R/ A449L/N450R/A468S/P470Q/D489E/ Q490E/Q505A/A511S/R514H/ Q536W/E537P/P539L/A545I/ Y582R/E620V/A639T/A646V/ Q664R | ++ | ++ | + |
| 1171/1172 | S581T | E35G/S205R/M236V/Q258K/ E261D/L300F/A301V/A308E/ N339W/V347F/S370C/A408V/ S439M/V442L/P446R/A449L/ N450R/A468S/P470Q/D489E/Q490E/ Q505A/A511S/R514H/Q536W/ E537P/P539L/A545I/S581T/ Y582R/E620V/A639T/A646V/ Q664R | + | ++ | + |

[1]All activities were determined relative to the reference polypeptide of SEQ ID NO: 1030. Levels of increased activity are defined as follows: "+" = 0.9 to 1.1; "++" > 1.1; "+++" > 1.5; and "++++" > 3.
[2]Amino Acid Differences does not include Histidine tag at C-terminus Based on the results shown in Table 3.22, SEQ ID NO: 1136 was chosen as the next parent sequence for the next iteration of protein optimization. Beneficial mutations identified from the results shown in Table 3.22 were recombined into this backbone. The variants were assayed in triplicate for protease activity at pH 6, and after a pre-incubation at pH 2.5, with 1.5 mg/mL pepsin for 1 hr, as described in Example 2. The results (relative to those obtained for SEQ ID NO: 1136) are provided in Table 3.23. Additionally, variants with mutations at different positions were also constructed using SEQ ID NO: 1136. These variants were assayed in singlicate for protease activity at pH 6, after a pre-incubation at pH 2.5, with 1.5 mg/mL pepsin for 2 hrs, as described in Example 2. The results (relative to the results obtained for SEQ ID NO: 1136) are provided in Table 3.24.

TABLE 3.23

Protease Activity Relative to SEQ ID NO: 1136[1]

| SEQ ID NO: (nt/aa) | Amino Acid Differences (Relative to SEQ ID NO: 1136) | Amino Acid Differences (Relative to SEQ ID NO: 2)[2] | Unchallenged Activity Improvement (Relative to SEQ ID NO: 1136) | Pepsin Pre-Incubation Improvement (Relative to SEQ ID NO: 1136) |
|---|---|---|---|---|
| 1173/1174 | N29S/S168E/ R648A | N29S/E35G/S168E/S205R/M236V/Q258K/ E261D/R263S/N266A/L300F/A301V/ A308E/N339W/V347F/S370C/A408V/S439M/ R441V/V442L/P446R/A449L/N450R/A468S/ P470Q/D489E/Q490E/Q505A/A511S/R514H/ Q536W/E537P/P539L/A545I/Y582R/ E620V/A639T/A646V/R648A/Q664R | ++ | ++ |
| 1175/1176 | R75S/E143Q/ S168E/K527L | E35G/R75S/E143Q/S168E/S205R/M236V/ Q258K/E261D/R263S/N266A/L300F/ A301V/A308E/N339W/V347F/S370C/A408V/ S439M/R441V/V442L/P446R/A449L/N450R/ A468S/P470Q/D489E/Q490E/Q505A/ A511S/R514H/K527L/Q536W/E537P/P539L/ A545I/Y582R/E620V/A639T/A646V/Q664R | ++ | ++ |
| 1177/1178 | R75S/S168E | E35G/R75S/S168E/S205R/M236V/Q258K/ E261D/R263S/N266A/L300F/A301V/ A308E/N339W/V347F/S370C/A408V/S439M/ | ++ | ++ |

TABLE 3.23-continued

Protease Activity Relative to SEQ ID NO: 1136[1]

| SEQ ID NO: (nt/aa) | Amino Acid Differences (Relative to SEQ ID NO: 1136) | Amino Acid Differences (Relative to SEQ ID NO: 2)[2] | Unchallenged Activity Improvement (Relative to SEQ ID NO: 1136) | Pepsin Pre-Incubation Improvement (Relative to SEQ ID NO: 1136) |
|---|---|---|---|---|
| 1179/1180 | E143Q | R441V/V442L/P446R/A449L/N450R/A468S/ P470Q/D489E/Q490E/Q505A/A511S/R514H/ Q536W/E537P/P539L/A545I/Y582R/ E620V/A639T/A646V/Q664R E35G/E143Q/S205R/M236V/Q258K/ E261D/R263S/N266A/L300F/A301V/A308E/ N339W/V347F/S370C/A408V/S439M/R441V/ V442L/P446R/A449L/N450R/A468S/P470Q/ D489E/Q490E/Q505A/A511S/R514H/ Q536W/E537P/P539L/A545I/Y582R/E620V/ A639T/A646V/Q664R | ++ | ++ |
| 1181/1182 | S168E/I495L/ K616T | E35G/S168E/S205R/M236V/Q258K/ E261D/R263S/N266A/L300F/A301V/A308E/ N339W/V347F/S370C/A408V/S439M/R441V/ V442L/P446R/A449L/N450R/A468S/P470Q/ D489E/Q490E/I495L/Q505A/A511S/R514H/ Q536W/E537P/P539L/A545I/Y582R/ K616T/E620V/A639T/A646V/Q664R | ++ | |
| 1183/1184 | N29S/S263T/ K527L/L568P | N29S/E35G/S205R/M236V/Q258K/E261D/ R263T/N266A/L300F/A301V/A308E/ N339W/V347F/S370C/A408V/S439M/R441V/ V442L/P446R/A449L/N450R/A468S/P470Q/ D489E/Q490E/Q505A/A511S/R514H/K527L/ Q536W/E537P/P539L/A545I/L568P/ Y582R/E620V/A639T/A646V/Q664R | ++ | |
| 1185/1186 | S168E/R482V/ K616T | E35G/S168E/S205R/M236V/Q258K/ E261D/R263S/N266A/L300F/A301V/A308E/ N339W/V347F/S370C/A408V/S439M/R441V/ V442L/P446R/A449L/N450R/A468S/P470Q/ R482V/D489E/Q490E/Q505A/A511S/R514H/ Q536W/E537P/P539L/A545I/Y582R/ K616T/E620V/A639T/A646V/Q664R | ++ | ++ |
| 1187/1188 | S168E/S263T/ K616T | E35G/S168E/S205R/M236V/Q258K/ E261D/R263T/N266A/L300F/A301V/A308E/ N339W/V347F/S370C/A408V/S439M/R441V/ V442L/P446R/A449L/N450R/A468S/P470Q/ D489E/Q490E/Q505A/A511S/R514H/ Q536W/E537P/P539L/A545I/Y582R/K616T/ E620V/A639T/A646V/Q664R | ++ | |
| 1189/1190 | N29S/R30G/ E143Q/S263T/ R482V/V646E | N29S/R30G/E35G/E143Q/S205R/M236V/ Q258K/E261D/R263T/N266A/L300F/A301V/ A308E/N339W/V347F/S370C/A408V/ S439M/R441V/V442L/P446R/A449L/N450R/ A468S/P470Q/R482V/D489E/Q490E/Q505A/ A511S/R514H/Q536W/E537P/P539L/A545I/ Y582R/E620V/A639T/A646E/Q664R | ++ | + |
| 1191/1192 | I495L | E35G/S205R/M236V/Q258K/E261D/ R263S/N266A/L300F/A301V/A308E/N339W/ V347F/S370C/A408V/S439M/R441V/V442L/ P446R/A449L/N450R/A468S/P470Q/D489E/ Q490E/I495L/Q505A/A511S/R514H/Q536W/ E537P/P539L/A545I/Y582R/E620V/A639T/ A646V/Q664R | + | |
| 1193/1194 | N29S/R30G/ S263T | N29S/R30G/E35G/S205R/M236V/Q258K/ E261D/R263T/N266A/L300F/A301V/A308E/ N339W/V347F/S370C/A408V/S439M/ R441V/V442L/P446R/A449L/N450R/A468S/ P470Q/D489E/Q490E/Q505A/A511S/R514H/ Q536W/E537P/P539L/A545I/Y582R/E620V/ A639T/A646V/Q664R | + | ++ |
| 1195/1196 | R75S | E35G/R75S/S205R/M236V/Q258K/E261D/ R263S/N266A/L300F/A301V/A308E/ N339W/V347F/S370C/A408V/S439M/R441V/ V442L/P446R/A449L/N450R/A468S/P470Q/ D489E/Q490E/Q505A/A511S/R514H/ Q536W/E537P/P539L/A545I/Y582R/E620V/ A639T/A646V/Q664R | + | + |
| 1197/1198 | N29S/R30G/ K616T/R648A | N29S/R30G/E35G/S205R/M236V/Q258K/ E261D/R263S/N266A/L300F/A301V/A308E/ N339W/V347F/S370C/A408V/S439M/ R441V/V442L/P446R/A449L/N450R/A468S/ | + | + |

TABLE 3.23-continued

Protease Activity Relative to SEQ ID NO: 1136[1]

| SEQ ID NO: (nt/aa) | Amino Acid Differences (Relative to SEQ ID NO: 1136) | Amino Acid Differences (Relative to SEQ ID NO: 2)[2] | Unchallenged Activity Improvement (Relative to SEQ ID NO: 1136) | Pepsin Pre-Incubation Improvement (Relative to SEQ ID NO: 1136) |
|---|---|---|---|---|
| 1199/1200 | S263T | P470Q/D489E/Q490E/Q505A/A511S/R514H/ Q536W/E537P/P539L/A545I/Y582R/K616T/ E620V/A639T/A646V/R648A/Q664R E35G/S205R/M236V/Q258K/E261D/ R263T/N266A/L300F/A301V/A308E/N339W/ V347F/S370C/A408V/S439M/R441V/V442L/ P446R/A449L/N450R/A468S/P470Q/D489E/ Q490E/Q505A/A511S/R514H/Q536W/E537P/ P539L/A545I/Y582R/E620V/A639T/ A646V/Q664R | + | ++ |
| 1201/1202 | R75S/K616T | E35G/R75S/S205R/M236V/Q258K/E261D/ R263S/N266A/L300F/A301V/A308E/ N339W/V347F/S370C/A408V/S439M/R441V/ V442L/P446R/A449L/N450R/A468S/P470Q/ D489E/Q490E/Q505A/A511S/R514H/ Q536W/E537P/P539L/A545I/Y582R/K616T/ E620V/A639T/A646V/Q664R | + | ++ |
| 1203/1204 | N29S/R75S/ S263T/L568P/ K570E/R648A | N29S/E35G/R75S/S205R/M236V/Q258K/ E261D/R263T/N266A/L300F/A301V/A308E/ N339W/V347F/S370C/A408V/S439M/ R441V/V442L/P446R/A449L/N450R/A468S/ P470Q/D489E/Q490E/Q505A/A511S/R514H/ Q536W/E537P/P539L/A545I/L568P/K570E/ Y582R/E620V/A639T/A646V/R648A/Q664R | + | ++ |
| 1205/1206 | S263T/K616T | E35G/S205R/M236V/Q258K/E261D/ R263T/N266A/L300F/A301V/A308E/N339W/ V347F/S370C/A408V/S439M/R441V/V442L/ P446R/A449L/N450R/A468S/P470Q/D489E/ Q490E/Q505A/A511S/R514H/Q536W/E537P/ P539L/A545I/Y582R/K616T/E620V/ A639T/A646V/Q664R | + | + |
| 1207/1208 | N29S/R30G | N29S/R30G/E35G/S205R/M236V/Q258K/ E261D/R263S/N266A/L300F/A301V/A308E/ N339W/V347F/S370C/A408V/S439M/ R441V/V442L/P446R/A449L/N450R/A468S/ P470Q/D489E/Q490E/Q505A/A511S/R514H/ Q536W/E537P/P539L/A545I/Y582R/E620V/ A639T/A646V/Q664R | + | ++ |
| 1209/1210 | K527T | E35G/S205R/M236V/Q258K/E261D/ R263S/N266A/L300F/A301V/A308E/N339W/ V347F/S370C/A408V/S439M/R441V/V442L/ P446R/A449L/N450R/A468S/P470Q/D489E/ Q490E/Q505A/A511S/R514H/K527T/ Q536W/E537P/P539L/A545I/Y582R/E620V/ A639T/A646V/Q664R | | ++ |
| 1211/1212 | S168E/G247S/ R482V/R648A | E35G/S168E/S205R/M236V/G247S/Q258K/ E261D/R263S/N266A/L300F/A301V/ A308E/N339W/V347F/S370C/A408V/S439M/ R441V/V442L/P446R/A449L/N450R/A468S/ P470Q/R482V/D489E/Q490E/Q505A/A511S/ R514H/Q536W/E537P/P539L/A545I/ Y582R/E620V/A639T/A646V/R648A/Q664R | | + |
| 1213/1214 | N29S | N29S/E35G/S205R/M236V/Q258K/E261D/ R263S/N266A/L300F/A301V/A308E/ N339W/V347F/S370C/A408V/S439M/R441V/ V442L/P446R/A449L/N450R/A468S/P470Q/ D489E/Q490E/Q505A/A511S/R514H/ Q536W/E537P/P539L/A545I/Y582R/E620V/ A639T/A646V/Q664R | | ++ |
| 1215/1216 | K429P/I545V | E35G/S205R/M236V/Q258K/E261D/ R263S/N266A/L300F/A301V/A308E/N339W/ V347F/S370C/A408V/K429P/S439M/R441V/ V442L/P446R/A449L/N450R/A468S/P470Q/ D489E/Q490E/Q505A/A511S/R514H/ Q536W/E537P/P539L/A545V/Y582R/E620V/ A639T/A646V/Q664R | | + |

[1] All activities were determined relative to the reference polypeptide of SEQ ID NO: 1136. Levels of increased activity are defined as follows: "+" = 0.9 to 1.1; "++" > 1.1; "+++" > 1.5; and "++++" > 3.
[2] Amino Acid Differences does not include Histidine tag at C-terminus

TABLE 3.24

Protease Activity Relative to SEQ ID NO: 1136[1]

| SEQ ID NO: (nt/aa) | Amino Acid Differences (Relative to SEQ ID NO: 1136) | Amino Acid Differences (Relative to SEQ ID NO: 2)[2] | Pepsin Pre-Incubation Improvement (Relative to SEQ ID NO: 1136) |
|---|---|---|---|
| 1217/1218 | A266K | E35G/E143Q/S205R/M236V/Q258K/E261D/R263S/N266K/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | +++ |
| 1219/1220 | A454L | E35G/E143Q/S205R/M236V/Q258K/E261D/R263S/N266A/L300F/A301V/A308E/N339W/V347F/S370C/A408V/S439M/R441V/V442L/P446R/A449L/N450R/A454L/A468S/P470Q/D489E/Q490E/Q505A/A511S/R514H/Q536W/E537P/P539L/A545I/Y582R/E620V/A639T/A646V/Q664R | ++ |
| 1221/1222 | H580C | E35G/E143Q/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R H580C | ++ |
| 1223/1224 | A610R | E35G/E143Q/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/A610R/E620V/A639T/A646V/Q664R | ++ |
| 1225/1226 | D548S | E35G/E143Q/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/D548S/Y582R/E620V/A639T/A646V/Q664R | ++ |
| 1227/1228 | V546R | E35G/E143Q/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/V546R/Y582R/E620V/A639T/A646V/Q664R | ++ |
| 1229/1230 | Q207R | E35G/E143Q/S205R/Q207R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | ++ |
| 1231/1232 | H604P | E35G/E143Q/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/H604P/E620V/A639T/A646V/Q664R | ++ |
| 1233/1234 | Q307L | E35G/E143Q/S205R/M236V/Q258K/E261D/R263S/N266A/L300F/A301V/Q307L/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | ++ |
| 1235/1236 | E535V | E35G/E143Q/S205R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/E535V/Q536W/E537P/P539L/A545I/Y582R/E620V/A639T/A646V/Q664R | ++ |
| 1237/1238 | S222T | E35G/E143Q/S205R/S222T/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | + |

[1] All activities were determined relative to the reference polypeptide of SEQ ID NO: 1136. Levels of increased activity are defined as follows: "+" = 0.9 to 1.1; "++" > 1.1; "+++" > 1.5; and "++++" > 3.
[2] Amino Acid Differences does not include Histidine tag at C-terminus Based on the results shown in Table 3.23, SEQ ID NO: 1180 was chosen as the next parent sequence for the next iteration of protein optimization. Beneficial mutations identified based on the results shown in Table 3.23 and Table 3.24 were recombined into this backbone. Additionally, variants were also constructed using SEQ ID NO: 1180, with mutagenesis at different positions. The variants were purified and assayed in triplicate for protease activity at pH 6, after a pre-incubation at pH 2.5, with 1.5 mg/mL pepsin for 1 hr, and also for autolysis stability after incubation for 24 hours at 37° C., as described in Example 2. The results (relative to those obtained for SEQ ID NO: 1180) are provided in Table 3.25.

TABLE 3.25

| | | | Protease Activity Relative to SEQ ID NO: 1180[1] | | |
|---|---|---|---|---|---|
| SEQ ID NO: (nt/aa) | Amino Acid Differences (Relative to SEQ ID NO: 1180) | Amino Acid Differences (Relative to SEQ ID NO: 2)[2] | Unchallenged Activity Improvement (Relative to SEQ ID NO: 1180) | Pepsin Pre-Incubation Improvement (Relative to SEQ ID NO: 1180) | Autolysis Stability Improvement (Relative to SEQ ID NO: 1180) |
| 1239/1240 | A266K/ A454L/ L568P | E35G/E143Q/S205R/M236V/ Q258K/E261D/R263S/N266K/L300F/ A301V/A308E/N339W/V347F/ S370C/A408V/S439M/R441V/ V442L/A454L/P446R/A449L/N450R/ A468S/P470Q/D489E/Q490E/ Q505A/A511S/R514H/Q536W/E537P/ P539L/A545I/L568P/Y582R/ E620V/A639T/A646V/Q664R | ++ | +++ | + |
| 1241/1242 | A454I | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A454I/ A468S/P470Q/D489E/Q490E/ Q505A/A511S/R514H/Q536W/E537P/ P539L/A545I/Y582R/E620V/ A639T/A646V/Q664R | ++ | ++ | + |
| 1243/1244 | A454L/ E659T | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A454L/ A468S/P470Q/D489E/Q490E/ Q505A/A511S/R514H/Q536W/E537P/ P539L/A545I/Y582R/E620V/ A639T/A646V/E659T/Q664R | + | ++ | |
| 1245/1246 | A454L/ H580C | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A454L/ A468S/P470Q/D489E/Q490E/ Q505A/A511S/R514H/Q536W/E537P/ P539L/A545I/H580C/Y582R/ E620V/A639T/A646V/Q664R | + | +++ | + |
| 1247/1248 | A454L/K570E/ H580C/ A610R | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A454L/ A468S/P470Q/D489E/Q490E/ Q505A/A511S/R514H/Q536W/E537P/ P539L/A545I/K570E/H580C/ Y582R/A610R/E620V/A639T/A646V/ Q664R | + | +++ | + |
| 1249/1250 | A454L/V546R/ K570E | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A454L/ A468S/P470Q/D489E/Q490E/ Q505A/A511S/R514H/Q536W/E537P/ P539L/A545I/V546R/K570E/ Y582R/E620V/A639T/A646V/Q664R | ++ | +++ | ++ |
| 1251/1252 | A454L/V546R/ L568P/K570E/ H580C | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A454L/ A468S/P470Q/D489E/Q490E/ Q505A/A511S/R514H/Q536W/E537P/ P539L/A545I/V546R/L568P/ K570E/H580C/Y582R/E620V/A639T/ A646V/Q664R | + | +++ | + |

TABLE 3.25-continued

Protease Activity Relative to SEQ ID NO: 1180[1]

| SEQ ID NO: (nt/aa) | Amino Acid Differences (Relative to SEQ ID NO: 1180) | Amino Acid Differences (Relative to SEQ ID NO: 2)[2] | Unchallenged Activity Improvement (Relative to SEQ ID NO: 1180) | Pepsin Pre-Incubation Improvement (Relative to SEQ ID NO: 1180) | Autolysis Stability Improvement (Relative to SEQ ID NO: 1180) |
|---|---|---|---|---|---|
| 1253/1254 | D212S | E35G/E143Q/S205R/D212S/ M236V/Q258K/E261D/R263S/N266A/ L300F/A301V/A308E/N339W/ V347F/S370C/A408V/S439M/R441V/ V442L/P446R/A449L/N450R/ A468S/P470Q/D489E/Q490E/Q505A/ A511S/R514H/Q536W/E537P/ P539L/A545I/Y582R/E620V/A639T/ A646V/Q664R | ++ | ++ | ++ |
| 1255/1256 | F412Y/V546L/ L554M | E35G/E143Q/S205R/M236V/ Q258K/E261D/R263S/N266A/L300F/ A301V/A308E/N339W/V347F/ S370C/A408V/F412Y/S439M/ R441V/V442L/P446R/A449L/N450R/ A468S/P470Q/D489E/Q490E/ Q505A/A511S/R514H/Q536W/E537P/ P539L/A545I/V546L/L554M/ Y582R/E620V/A639T/A646V/Q664R | + | ++ | ++ |
| 1257/1258 | G506N | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A468S/ P470Q/D489E/Q490E/Q505A/ G506N/A511S/R514H/Q536W/E537P/ P539L/A545I/Y582R/E620V/ A639T/A646V/Q664R | ++ | ++ | ++ |
| 1259/1260 | I209V | E35G/E143Q/S205R/I209V/ M236V/Q258K/E261D/R263S/N266A/ L300F/A301V/A308E/N339W/ V347F/S370C/A408V/S439M/R441V/ V442L/P446R/A449L/N450R/ A468S/P470Q/D489E/Q490E/Q505A/ A511S/R514H/Q536W/E537P/ P539L/A545I/Y582R/E620V/A639T/ A646V/Q664R I209V | ++ | ++ | ++ |
| 1261/1262 | L221I | E35G/E143Q/S205R/M236V/ Q258K/E261D/R263S/N266A/L300F/ A301V/A308E/N339W/V347F/ S370C/A408V/S439M/R441V/ V442L/P446R/A449L/N450R/A468S/ P470Q/D489E/Q490E/Q505A/ A511S/R514H/Q536W/E537P/P539L/ A545I/Y582R/E620V/A639T/ A646V/Q664R | + | ++ | ++ |
| 1263/1264 | L373F | E35G/E143Q/S205R/M236V/ Q258K/E261D/R263S/N266A/L300F/ A301V/A308E/N339W/V347F/ S370C/L373F/A408V/S439M/ R441V/V442L/P446R/A449L/N450R/ A468S/P470Q/D489E/Q490E/ Q505A/A511S/R514H/Q536W/E537P/ P539L/A545I/Y582R/E620V/ A639T/A646V/Q664R | + | ++ | + |
| 1265/1266 | N223Q | E35G/E143Q/S205R/N223Q/ M236V/Q258K/E261D/R263S/N266A/ L300F/A301V/A308E/N339W/ V347F/S370C/A408V/S439M/ R441V/V442L/P446R/A449L/N450R/ A468S/P470Q/D489E/Q490E/ Q505A/A511S/R514H/Q536W/E537P/ P539L/A545I/Y582R/E620V/A639T/ A646V/Q664R | ++ | + | ++ |

TABLE 3.25-continued

Protease Activity Relative to SEQ ID NO: 1180[1]

| SEQ ID NO: (nt/aa) | Amino Acid Differences (Relative to SEQ ID NO: 1180) | Amino Acid Differences (Relative to SEQ ID NO: 2)[2] | Unchallenged Activity Improvement (Relative to SEQ ID NO: 1180) | Pepsin Pre-Incubation Improvement (Relative to SEQ ID NO: 1180) | Autolysis Stability Improvement (Relative to SEQ ID NO: 1180) |
|---|---|---|---|---|---|
| 1267/1268 | N319Q | E35G/E143Q/S205R/M236V/Q258K/E261D/R263S/N266A/L300F/A301V/A308E/N319Q/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | + | ++ | ++ |
| 1269/1270 | P431T | E35G/E143Q/S205R/M236V/Q258K/E261D/R263S/N266A/L300F/A301V/A308E/N339W/V347F/S370C/A408V/P431T/S439M/R441V/V442L/P446R/A449L/N450R/A468S/P470Q/D489E/Q490E/Q505A/A511S/R514H/Q536W/E537P/P539L/A545I/Y582R/E620V/A639T/A646V/Q664R | + | ++ | ++ |
| 1271/1272 | Q207R/H604P/A610R | E35G/E143Q/S205R/Q207R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/Q505A/A511S/R514H/Q536W/E537P/P539L/A545I/Y582R/H604P/A610R/E620V/A639T/A646V/Q664R | ++ | + | ++ |
| 1273/1274 | R75S/A266K/A454L | E35G/R75S/E143Q/S205R/M236V/Q258K/E261D/R263S/N266K/L300F/A301V/A308E/N339W/V347F/S370C/A408V/S439M/R441V/V442L/P446R/A449L/N450R/A454L/A468S/P470Q/D489E/Q490E/Q505A/A511S/R514H/Q536W/E537P/P539L/A545I/Y582R/E620V/A639T/A646V/Q664R | ++ | ++ | + |
| 1275/1276 | R75S/A454L | E35G/R75S/E143Q/S205R/M236V/Q258K/E261D/R263S/N266A/L300F/A301V/A308E/N339W/V347F/S370C/A408V/S439M/R441V/V442L/P446R/A449L/N450R/A454L/A468S/P470Q/D489E/Q490E/Q505A/A511S/R514H/Q536W/E537P/P539L/A545I/Y582R/E620V/A639T/A646V/Q664R | + | +++ | + |
| 1277/1278 | R75S/A454L/V546R/D548S/L568P/H604P | E35G/R75S/E143Q/S205R/M236V/Q258K/E261D/R263S/N266A/L300F/A301V/A308E/N339W/V347F/S370C/A408V/S439M/R441V/V442L/P446R/A449L/N450R/A454L/A468S/P470Q/D489E/Q490E/Q505A/A511S/R514H/Q536W/E537P/P539L/A545I/V546R/D548S/L568P/Y582R/H604P/E620V/A639T/A646V/Q664R | ++ | +++ | ++ |
| 1279/1280 | R75S/Q207R/A454L/K570E/E659T | E35G/R75S/E143Q/S205R/Q207R/M236V/Q258K/E261D/R263S/N266A/L300F/A301V/A308E/N339W/V347F/S370C/A408V/S439M/R441V/V442L/P446R/A449L/N450R/A454L/A468S/P470Q/D489E/Q490E/Q505A/A511S/R514H/Q536W/E537P/P539L/A545I/K570E/Y582R/E620V/A639T/A646V/E659T/Q664R | ++ | +++ | ++ |
| 1281/1282 | R75S/Q207R/V546R/H580C/R648A | E35G/R75S/E143Q/S205R/Q207R/M236V/Q258K/E261D/R263S/N266A/L300F/A301V/A308E/N339W/V347F/S370C/A408V/S439M/R441V/V442L/P446R/A449L/N450R/A468S/P470Q/D489E/Q490E/ | ++ | + | ++ |

TABLE 3.25-continued

Protease Activity Relative to SEQ ID NO: 1180[1]

| SEQ ID NO: (nt/aa) | Amino Acid Differences (Relative to SEQ ID NO: 1180) | Amino Acid Differences (Relative to SEQ ID NO: 2)[2] | Unchallenged Activity Improvement (Relative to SEQ ID NO: 1180) | Pepsin Pre-Incubation Improvement (Relative to SEQ ID NO: 1180) | Autolysis Stability Improvement (Relative to SEQ ID NO: 1180) |
|---|---|---|---|---|---|
| | | Q505A/A511S/R514H/Q536W/ E537P/P539L/A545I/V546R/H580C/ Y582R/E620V/A639T/A646V/ R648A/Q664R | | | |
| 1283/1284 | R75S/S168E/ A266K/A454L/ V546R/K570E/ H580C | E35G/R75S/E143Q/S168E/S205R/ M236V/Q258K/E261D/R263S/ N266K/L300F/A301V/A308E/ N339W/V347F/S370C/A408V/S439M/ R441V/V442L/P446R/A449L/ N450R/A454L/A468S/P470Q/D489E/ Q490E/Q505A/A511S/R514H/ Q536W/E537P/P539L/A545I/V546R/ K570E/H580C/Y582R/E620V/ A639T/A646V/Q664R | ++ | +++ | + |
| 1285/1286 | R75S/S168E/ Q207R/A454L/ L568P/L586V/ A610R/R648A/ E659T | E35G/R75S/E143Q/S168E/S205R/ Q207R/M236V/Q258K/E261D/ R263S/N266A/L300F/A301V/ A308E/N339W/V347F/S370C/A408V/ S439M/R441V/V442L/P446R/ A449L/N450R/A454L/A468S/P470Q/ D489E/Q490E/Q505A/A511S/ R514H/Q536W/E537P/P539L/A545I/ L568P/Y582R/L586V/A610R/ E620V/A639T/A646V/R648A/E659T/ Q664R | +++ | +++ | + |
| 1287/1288 | R75S/S263T/ A454L/D548S/ L568P/H604P/ R648A | E35G/R75S/E143Q/S205R/ M236V/Q258K/E261D/R263T/N266A/ L300F/A301V/A308E/N339W/ V347F/S370C/A408V/S439M/ R441V/V442L/P446R/A449L/N450R/ A454L/A468S/P470Q/D489E/ Q490E/Q505A/A511S/R514H/Q536W/ E537P/P539L/A545I/D548S/L568P/ Y582R/H604P/E620V/A639T/ A646V/R648A/Q664R | + | ++ | |
| 1289/1290 | R75S/V546R/ D548S/A610R/ R648A | E35G/R75S/E143Q/S205R/ M236V/Q258K/E261D/R263S/N266A/ L300F/A301V/A308E/N339W/ V347F/S370C/A408V/S439M/R441V/ V442L/P446R/A449L/N450R/ A468S/P470Q/D489E/Q490E/Q505A/ A511S/R514H/Q536W/E537P/ P539L/A545I/V546R/D548S/Y582R/ A610R/E620V/A639T/A646V/ R648A/Q664R | ++ | + | ++ |
| 1291/1292 | S168E/A454L/ H604P | E35G/E143Q/S168E/S205R/ M236V/Q258K/E261D/R263S/N266A/ L300F/A301V/A308E/N339W/ V347F/S370C/A408V/S439M/R441V/ V442L/P446R/A449L/N450R/ A454L/A468S/P470Q/D489E/Q490E/ Q505A/A511S/R514H/Q536W/ E537P/P539L/A545I/Y582R/H604P/ E620V/A639T/A646V/Q664R | ++ | +++ | |
| 1293/1294 | S168E/Q207R/ S263T/A454L/ L568P/K570E/ H604P | E35G/E143Q/S168E/S205R/ Q207R/M236V/Q258K/E261D/R263T/ N266A/L300F/A301V/A308E/ N339W/V347F/S370C/A408V/ S439M/R441V/V442L/P446R/A449L/ N450R/A454L/A468S/P470Q/ D489E/Q490E/Q505A/A511S/R514H/ Q536W/E537P/P539L/A545I/ L568P/K570E/Y582R/E620V/H604P/ A639T/A646V/Q664R | ++ | +++ | ++ |
| 1295/1296 | S168E/S263T/ A266K/V546R/ H604P | E35G/E143Q/S168E/S205R/ M236V/Q258K/E261D/R263T/N266K/ L300F/A301V/A308E/N339W/ V347F/S370C/A408V/S439M/ R441V/V442L/P446R/A449L/N450R/ A468S/P470Q/D489E/Q490E/ Q505A/A511S/R514H/Q536W/E537P/ | ++ | + | |

TABLE 3.25-continued

Protease Activity Relative to SEQ ID NO: 1180[1]

| SEQ ID NO: (nt/aa) | Amino Acid Differences (Relative to SEQ ID NO: 1180) | Amino Acid Differences (Relative to SEQ ID NO: 2)[2] | Unchallenged Activity Improvement (Relative to SEQ ID NO: 1180) | Pepsin Pre-Incubation Improvement (Relative to SEQ ID NO: 1180) | Autolysis Stability Improvement (Relative to SEQ ID NO: 1180) |
|---|---|---|---|---|---|
| 1297/1298 | T228I | E35G/E143Q/S205R/T228I/ M236V/Q258K/E261D/R263S/N266A/ L300F/A301V/A308E/N339W/ V347F/S370C/A408V/S439M/R441V/ V442L/P446R/A449L/N450R/ A468S/P470Q/D489E/Q490E/Q505A/ A511S/R514H/Q536W/E537P/ P539L/A545I/V546R/Y582R/H604P/ E620V/A639T/A646V/Q664R | + | ++ | ++ |
| 1299/1300 | T228V | E35G/E143Q/S205R/T228V/ M236V/Q258K/E261D/R263S/N266A/ L300F/A301V/A308E/N339W/ V347F/S370C/A408V/S439M/ R441V/V442L/P446R/A449L/N450R/ A468S/P470Q/D489E/Q490E/ Q505A/A511S/R514H/Q536W/E537P/ P539L/A545I/Y582R/E620V/A639T/ A646V/Q664R | + | ++ | ++ |

[1]All activities were determined relative to the reference polypeptide of SEQ ID NO: 1180. Levels of increased activity are defined as follows: "+" = 0.9 to 1.1; "++" > 1.1; "+++" > 1.5; and "++++" > 3.
[2]Amino Acid Differences does not include Histidine tag at C-terminus Based on the results from Table 3.25, SEQ ID NO: 1250 was chosen as the next parent sequence for the next iteration of protein optimization. Beneficial mutations identified based on the results shown in Table 3.25 were recombined into this backbone. The variants were purified and assayed in triplicate for protease activity at pH 6, after a pre-incubation at pH 2.75, with 1.5 mg/mL pepsin for 2 hrs, and also for autolysis stability by assaying for protease activity after incubation for 24 hours at 37° C., as described in Example 2. The results (relative to the results obtained for SEQ ID NO: 1250) are provided in Table 3.26.

TABLE 3.26

Protease Activity Relative to SEQ ID NO: 1250[1]

| SEQ ID NO: (nt/aa) | Amino Acid Differences (Relative to SEQ ID NO: 1250) | Amino Acid Differences (Relative to SEQ ID NO: 2)[2] | Unchallenged Activity Improvement (Relative to SEQ ID NO: 1250) | Pepsin Pre-Incubation Improvement (Relative to SEQ ID NO: 1250) | Autolysis Stability Improvement (Relative to SEQ ID NO: 1250) |
|---|---|---|---|---|---|
| 1301/1302 | K189A/D212S/ P431T/L568P/ E570K | E35G/E143Q/K189A/S205R/ D212S/M236V/Q258K/E261D/ R263S/N266A/L300F/A301V/ A308E/N339W/V347F/S370C/ A408V/P431T/S439M/R441V/ V442L/P446R/A449L/N450R/A454L/ A468S/P470Q/D489E/Q490E/ Q505A/A511S/R514H/Q536W/ E537P/P539L/A545I/V546R/ L568P/Y582R/E620V/A639T/ A646V/Q664R | +++ | ++ | |
| 1303/1304 | R75S/K189A/ L373F/R582G | E35G/R75S/E143Q/K189A/ S205R/M236V/Q258K/E261D/ R263S/N266A/L300F/A301V/ A308E/N339W/V347F/S370C/ L373F/A408V/S439M/R441V/V442L/ P446R/A449L/N450R/A454L/ A468S/P470Q/D489E/Q490E/ Q505A/A511S/R514H/Q536W/ E537P/P539L/A545I/V546R/ K570E/Y582G/E620V/A639T/A646V/ Q664R | ++ | ++ | + |
| 1305/1306 | D212S/T228V/ L568P/E570K/ R582G/R664W | E35G/E143Q/S205R/D212S/ T228V/M236V/Q258K/E261D/ R263S/N266A/L300F/A301V/ A308E/N339W/V347F/S370C/ | ++ | ++ | + |

TABLE 3.26-continued

| | | | Protease Activity Relative to SEQ ID NO: 1250[1] | | |
|---|---|---|---|---|---|
| SEQ ID NO: (nt/aa) | Amino Acid Differences (Relative to SEQ ID NO: 1250) | Amino Acid Differences (Relative to SEQ ID NO: 2)[2] | Unchallenged Activity Improvement (Relative to SEQ ID NO: 1250) | Pepsin Pre-Incubation Improvement (Relative to SEQ ID NO: 1250) | Autolysis Stability Improvement (Relative to SEQ ID NO: 1250) |
| | | A408V/S439M/R441V/V442L/ P446R/A449L/N450R/A454L/A468S/ P470Q/D489E/Q490E/Q505A/ A511S/R514H/Q536W/E537P/ P539L/A545I/V546R/L568P/ Y582G/E620V/A639T/A646V/Q664W | | | |
| 1307/1308 | R75S/D212S/ P431T/R482S/ L568P/K615M/ R664G | E35G/R75S/E143Q/S205R/ D212S/M236V/Q258K/E261D/ R263S/N266A/L300F/A301V/ A308E/N339W/V347F/S370C/A408V/ P431T/S439M/R441V/V442L/ P446R/A449L/N450R/A454L/ A468S/P470Q/R482S/D489E/ Q490E/Q505A/A511S/R514H/ Q536W/E537P/P539L/A545I/V546R/ L568P/K570E/Y582R/K615M/ E620V/A639T/A646V/Q664G | + | ++ | + |
| 1309/1310 | R582G | E35G/E143Q/S205R/M236V/ Q258K/E261D/R263S/N266A/ L300F/A301V/A308E/N339W/ V347F/S370C/A408V/S439M/ R441V/V442L/P446R/A449L/ N450R/A454L/A468S/P470Q/D489E/ Q490E/Q505A/A511S/R514H/ Q536W/E537P/P539L/A545I/ V546R/K570E/Y582G/E620V/ A639T/A646V/Q664R | + | ++ | ++ |
| 1311/1312 | R75S/P431T/ R482S/E570K/ H604P/R664G | E35G/R75S/E143Q/S205R/ M236V/Q258K/E261D/R263S/ N266A/L300F/A301V/A308E/ N339W/V347F/S370C/A408V/ P431T/S439M/R441V/V442L/P446R/ A449L/N450R/A454L/A468S/ P470Q/R482S/D489E/Q490E/ Q505A/A511S/R514H/Q536W/ E537P/P539L/A545I/V546R/ Y582R/H604P/E620V/A639T/ A646V/Q664G | + | ++ | ++ |
| 1313/1314 | D212S/T228V/ P431T | E35G/E143Q/S205R/D212S/ T228V/M236V/Q258K/E261D/ R263S/N266A/L300F/A301V/ A308E/N339W/V347F/S370C/ A408V/P431T/S439M/R441V/ V442L/P446R/A449L/N450R/A454L/ A468S/P470Q/D489E/Q490E/ Q505A/A511S/R514H/Q536W/ E537P/P539L/A545I/V546R/ K570E/Y582R/E620V/A639T/ A646V/Q664R | + | ++ | |
| 1315/1316 | R75S/K368M/ R582G | E35G/R75S/E143Q/S205R/ M236V/Q258K/E261D/R263S/ N266A/L300F/A301V/A308E/ N339W/V347F/K368M/S370C/ A408V/S439M/R441V/V442L/ P446R/A449L/N450R/A454L/A468S/ P470Q/D489E/Q490E/Q505A/ A511S/R514H/Q536W/E537P/ P539L/A545I/V546R/K570E/ Y582G/E620V/A639T/A646V/ Q664R | + | ++ | ++ |
| 1317/1318 | K615M/K652V/ R664G | E35G/E143Q/S205R/M236V/ Q258K/E261D/R263S/N266A/ L300F/A301V/A308E/N339W/ V347F/S370C/A408V/S439M/ R441V/V442L/P446R/A449L/ N450R/A454L/A468S/P470Q/D489E/ Q490E/Q505A/A511S/R514H/ Q536W/E537P/P539L/A545I/ V546R/K570E/Y582R/K615M/ E620V/A639T/A646V/K652V/ Q664G | + | ++ | ++ |

TABLE 3.26-continued

| | | | Protease Activity Relative to SEQ ID NO: 1250[1] | | |
|---|---|---|---|---|---|
| SEQ ID NO: (nt/aa) | Amino Acid Differences (Relative to SEQ ID NO: 1250) | Amino Acid Differences (Relative to SEQ ID NO: 2)[2] | Unchallenged Activity Improvement (Relative to SEQ ID NO: 1250) | Pepsin Pre-Incubation Improvement (Relative to SEQ ID NO: 1250) | Autolysis Stability Improvement (Relative to SEQ ID NO: 1250) |
| 1319/1320 | R75S/D212S/ L373F/P431T/ R482S | E35G/R75S/E143Q/S205R/ D212S/M236V/Q258K/E261D/ R263S/N266A/L300F/A301V/ A308E/N339W/V347F/S370C/L373F/ A408V/P431T/S439M/R441V/ V442L/P446R/A449L/N450R/ A454L/A468S/P470Q/R482S/ D489E/Q490E/Q505A/A511S/ R514H/Q536W/E537P/P539L/A545I/ V546R/K570E/Y582R/E620V/ A639T/A646V/Q664R | + | ++ | + |
| 1321/1322 | P431T | E35G/E143Q/S205R/M236V/ Q258K/E261D/R263S/N266A/ L300F/A301V/A308E/N339W/ V347F/S370C/A408V/P431T/ S439M/R441V/V442L/P446R/ A449L/N450R/A454L/A468S/P470Q/ D489E/Q490E/Q505A/A511S/ R514H/Q536W/E537P/P539L/ A545I/V546R/K570E/Y582R/ E620V/A639T/A646V/Q664R | + | ++ | + |
| 1323/1324 | R75S/K632Q | E35G/R75S/E143Q/S205R/ M236V/Q258K/E261D/R263S/ N266A/L300F/A301V/A308E/ N339W/V347F/S370C/A408V/ S439M/R441V/V442L/P446R/ A449L/N450R/A454L/A468S/P470Q/ D489E/Q490E/Q505A/A511S/ R514H/Q536W/E537P/P539L/ A545I/V546R/K570E/Y582R/ E620V/K632Q/A639T/A646V/ Q664R | + | + | ++ |
| 1325/1326 | K200W/P431T/ R482S/K615M/ R664G | E35G/E143Q/K200W/S205R/ M236V/Q258K/E261D/R263S/ N266A/L300F/A301V/A308E/ N339W/V347F/S370C/A408V/ P431T/S439M/R441V/V442L/ P446R/A449L/N450R/A454L/A468S/ P470Q/R482S/D489E/Q490E/ Q505A/A511S/R514H/Q536W/ E537P/P539L/A545I/V546R/ K570E/Y582R/K615M/E620V/A639T/ A646V/Q664G | + | +++ | ++ |
| 1327/1328 | R75S/K200W/ D212S/P431T/ R482S | E35G/R75S/E143Q/K200W/ S205R/D212S/M236V/Q258K/ E261D/R263S/N266A/L300F/ A301V/A308E/N339W/V347F/S370C/ A408V/P431T/S439M/R441V/ V442L/P446R/A449L/N450R/ A454L/A468S/P470Q/R482S/ D489E/Q490E/Q505A/A511S/ R514H/Q536W/E537P/P539L/A545I/ V546R/K570E/Y582R/E620V/ A639T/A646V/Q664R | + | +++ | + |
| 1329/1330 | L373F/L568P/ K632Q | E35G/E143Q/S205R/M236V/ Q258K/E261D/R263S/N266A/ L300F/A301V/A308E/N339W/ V347F/S370C/L373F/A408V/ S439M/R441V/V442L/P446R/ A449L/N450R/A454L/A468S/P470Q/ D489E/Q490E/Q505A/A511S/ R514H/Q536W/E537P/P539L/ A545I/V546R/L568P/K570E/ Y582R/E620V/K632Q/A639T/ A646V/Q664R | + | + | ++ |
| 1331/1332 | K368M/L373F/ P431T | E35G/E143Q/S205R/M236V/ Q258K/E261D/R263S/N266A/ L300F/A301V/A308E/N339W/ V347F/K368M/S370C/L373F/ A408V/P431T/S439M/R441V/ V442L/P446R/A449L/N450R/A454L/ | + | ++ | + |

TABLE 3.26-continued

| | | | Protease Activity Relative to SEQ ID NO: 1250[1] | | |
|---|---|---|---|---|---|
| SEQ ID NO: (nt/aa) | Amino Acid Differences (Relative to SEQ ID NO: 1250) | Amino Acid Differences (Relative to SEQ ID NO: 2)[2] | Unchallenged Activity Improvement (Relative to SEQ ID NO: 1250) | Pepsin Pre-Incubation Improvement (Relative to SEQ ID NO: 1250) | Autolysis Stability Improvement (Relative to SEQ ID NO: 1250) |
| | | A468S/P470Q/D489E/Q490E/ Q505A/A511S/R514H/Q536W/ E537P/P539L/A545I/V546R/ K570E/Y582R/E620V/A639T/ A646V/Q664R | | | |
| 1333/1334 | P431T/H604P/ R664G | E35G/E143Q/S205R/M236V/ Q258K/E261D/R263S/N266A/ L300F/A301V/A308E/N339W/ V347F/S370C/A408V/P431T/ S439M/R441V/V442L/P446R/ A449L/N450R/A454L/A468S/P470Q/ D489E/Q490E/Q505A/A511S/ R514H/Q536W/E537P/P539L/ A545I/V546R/K570E/Y582R/ H604P/E620V/A639T/A646V/Q664G | + | ++ | + |
| 1335/1336 | R75S/L373F/ P431T/R526E/ R582G | E35G/R75S/E143Q/S205R/ M236V/Q258K/E261D/R263S/ N266A/L300F/A301V/A308E/ N339W/V347F/S370C/L373F/ A408V/P431T/S439M/R441V/V442L/ P446R/A449L/N450R/A454L/ A468S/P470Q/D489E/Q490E/ Q505A/A511S/R514H/R526E/ Q536W/E537P/P539L/A545I/V546R/ K570E/Y582G/E620V/A639T/ A646V/Q664R | + | ++ | ++ |
| 1337/1338 | L373F/P431T/ E570K/H604P/ R664W | E35G/E143Q/S205R/M236V/ Q258K/E261D/R263S/N266A/ L300F/A301V/A308E/N339W/ V347F/S370C/L373F/A408V/ P431T/S439M/R441V/V442L/ P446R/A449L/N450R/A454L/A468S/ P470Q/D489E/Q490E/Q505A/ A511S/R514H/Q536W/E537P/ P539L/A545I/V546R/Y582R/ H604P/E620V/A639T/A646V/ Q664W | + | ++ | + |
| 1339/1340 | K200W/R482S/ R664W | E35G/E143Q/K200W/S205R/ M236V/Q258K/E261D/R263S/ N266A/L300F/A301V/A308E/ N339W/V347F/S370C/A408V/ S439M/R441V/V442L/P446R/ A449L/N450R/A454L/A468S/P470Q/ R482S/D489E/Q490E/Q505A/ A511S/R514H/Q536W/E537P/ P539L/A545I/V546R/K570E/ Y582R/E620V/A639T/A646V/ Q664W | | ++ | + |
| 1341/1342 | R482S/R582G | E35G/E143Q/S205R/M236V/ Q258K/E261D/R263S/N266A/ L300F/A301V/A308E/N339W/ V347F/S370C/A408V/S439M/ R441V/V442L/P446R/A449L/ N450R/A454L/A468S/P470Q/R482S/ D489E/Q490E/Q505A/A511S/ R514H/Q536W/E537P/P539L/ A545I/V546R/K570E/Y582G/ E620V/A639T/A646V/Q664R | | + | ++ |
| 1343/1344 | D212S/L373F/ R446F/R482S/ R582G | E35G/E143Q/S205R/D212S/ M236V/Q258K/E261D/R263S/ N266A/L300F/A301V/A308E/ N339W/V347F/S370C/L373F/ A408V/S439M/R441V/V442L/P446F/ A449L/N450R/A454L/A468S/ P470Q/R482S/D489E/Q490E/ Q505A/A511S/R514H/Q536W/ E537P/P539L/A545I/V546R/ K570E/Y582G/E620V/A639T/A646V/ Q664R | | | ++ |

TABLE 3.26-continued

Protease Activity Relative to SEQ ID NO: 1250[1]

| SEQ ID NO: (nt/aa) | Amino Acid Differences (Relative to SEQ ID NO: 1250) | Amino Acid Differences (Relative to SEQ ID NO: 2)[2] | Unchallenged Activity Improvement (Relative to SEQ ID NO: 1250) | Pepsin Pre-Incubation Improvement (Relative to SEQ ID NO: 1250) | Autolysis Stability Improvement (Relative to SEQ ID NO: 1250) |
|---|---|---|---|---|---|
| 1345/1346 | K200W/R205S/L373F/P431T | E35G/E143Q/K200W/M236V/Q258K/E261D/R263S/N266A/L300F/A301V/A308E/N339W/V347F/S370C/L373F/A408V/P431T/S439M/R441V/V442L/P446R/A449L/N450R/A454L/A468S/P470Q/D489E/Q490E/Q505A/A511S/R514H/Q536W/E537P/P539L/A545I/V546R/K570E/Y582R/E620V/A639T/A646V/Q664R | | ++ | + |

[1] All activities were determined relative to the reference polypeptide of SEQ ID NO: 1250. Levels of increased activity are defined as follows: "+" = 0.9 to 1.1; "++" > 1.1; "+++" > 1.5; and "++++" > 3.
[2] Amino Acid Differences does not include Histidine tag at C-terminus Based on the results shown in Table 3.26, SEQ ID NO: 1308 was chosen as the next parent sequence for the next iteration of protein optimization. A combinatorial library based on SEQ ID NO: 1308 diversity was recombined into this backbone. A saturation mutagenesis library at position 470 was also constructed using this backbone. The variants were purified and assayed in triplicate for protease activity at pH 6, after a pre-incubation at pH 2.75 with 1.5 mg/mL pepsin for 2 hrs, and for autolysis stability after incubation for 24 hours at 37° C., as described in Example 2. The results (relative to the results obtained for SEQ ID NO: 1308) are provided in Table 3.27.

TABLE 3.27

Protease Activity Relative to SEQ ID NO: 1308[1]

| SEQ ID NO: (nt/aa) | Amino Acid Differences (Relative to SEQ ID NO: 1308) | Amino Acid Differences (Relative to SEQ ID NO: 2)[2] | Unchallenged Activity Improvement (Relative to SEQ ID NO: 1308) | Pepsin Pre-Incubation Improvement (Relative to SEQ ID NO: 1308) |
|---|---|---|---|---|
| 1347/1348 | H514R/P537E | E35G/R75S/E143Q/S205R/D212S/M236V/Q258K/E261D/R263S/N266A/L300F/A301V/A308E/N339W/V347F/S370C/A408V/P431T/S439M/R441V/V442L/P446R/A449L/N450R/A454L/A468S/P470Q/R482S/D489E/Q490E/Q505A/A511S/R514H/Q536W/E537P/P539L/A545I/V546R/L568P/K570E/Y582R/K615M/E620V/A639T/A646V/Q664G | + | ++ |
| 1349/1350 | P537E | E35G/R75S/E143Q/S205R/D212S/M236V/Q258K/E261D/R263S/N266A/L300F/A301V/A308E/N339W/V347F/S370C/A408V/P431T/S439M/R441V/V442L/P446R/A449L/N450R/A454L/A468S/P470Q/R482S/D489E/Q490E/Q505A/A511S/R514H/Q536W/E537P/P539L/A545I/V546R/L568P/K570E/Y582R/K615M/E620V/A639T/A646V/Q664G | + | ++ |
| 1351/1352 | V408A/M439S | E35G/R75S/E143Q/S205R/D212S/M236V/Q258K/E261D/R263S/N266A/L300F/A301V/A308E/N339W/V347F/S370C/A408V/P431T/S439M/R441V/V442L/P446R/A449L/N450R/A454L/A468S/P470Q/R482S/D489E/Q490E/Q505A/A511S/R514H/Q536W/E537P/P539L/A545I/V546R/L568P/K570E/Y582R/K615M/E620V/A639T/A646V/Q664G | + | |
| 1353/1354 | M439S/H514R | E35G/R75S/E143Q/S205R/D212S/M236V/Q258K/E261D/R263S/N266A/L300F/A301V/A308E/N339W/V347F/S370C/A408V/P431T/S439M/R441V/V442L/P446R/A449L/N450R/A454L/A468S/P470Q/R482S/D489E/Q490E/Q505A/A511S/R514H/Q536W/E537P/P539L/A545I/V546R/L568P/K570E/Y582R/K615M/E620V/A639T/A646V/Q664G | + | |
| 1355/1356 | H514R | E35G/R75S/E143Q/S205R/D212S/M236V/Q258K/E261D/R263S/N266A/L300F/A301V/A308E/N339W/V347F/S370C/A408V/P431T/S439M/R441V/V442L/P446R/A449L/N450R/A454L/ | + | ++ |

TABLE 3.27-continued

Protease Activity Relative to SEQ ID NO: 1308[1]

| SEQ ID NO: (nt/aa) | Amino Acid Differences (Relative to SEQ ID NO: 1308) | Amino Acid Differences (Relative to SEQ ID NO: 2)[2] | Unchallenged Activity Improvement (Relative to SEQ ID NO: 1308) | Pepsin Pre-Incubation Improvement (Relative to SEQ ID NO: 1308) |
|---|---|---|---|---|
| 1357/1358 | Q470G/G667D | A468S/P470Q/R482S/D489E/Q490E/Q505A/A511S/ R514H/Q536W/E537P/P539L/A545I/V546R/ L568P/K570E/Y582R/K615M/E620V/A639T/A646V/ Q664G E35G/R75S/E143Q/S205R/D212S/M236V/ Q258K/E261D/R263S/N266A/L300F/A301V/A308E/ N339W/V347F/S370C/A408V/P431T/S439M/ R441V/V442L/P446R/A449L/N450R/A454L/ A468S/P470Q/R482S/D489E/Q490E/Q505A/A511S/ R514H/Q536W/E537P/P539L/A545I/V546R/ L568P/K570E/Y582R/K615M/E620V/A639T/A646V/ Q664G | + | ++ |
| 1359/1360 | Q470G | E35G/R75S/E143Q/S205R/D212S/M236V/ Q258K/E261D/R263S/N266A/L300F/A301V/A308E/ N339W/V347F/S370C/A408V/P431T/S439M/ R441V/V442L/P446R/A449L/N450R/A454L/ A468S/P470Q/R482S/D489E/Q490E/Q505A/A511S/ R514H/Q536W/E537P/P539L/A545I/V546R/ L568P/K570E/Y582R/K615M/E620V/A639T/A646V/ Q664G | ++ | ++ |
| 1361/1362 | Q470P | E35G/R75S/E143Q/S205R/D212S/M236V/ Q258K/E261D/R263S/N266A/L300F/A301V/A308E/ N339W/V347F/S370C/A408V/P431T/S439M/ R441V/V442L/P446R/A449L/N450R/A454L/ A468S/P470Q/R482S/D489E/Q490E/Q505A/A511S/ R514H/Q536W/E537P/P539L/A545I/V546R/ L568P/K570E/Y582R/K615M/E620V/A639T/A646V/ Q664G | +++ | |

[1]All activities were determined relative to the reference polypeptide of SEQ ID NO: 1308. Levels of increased activity are defined as follows: "+" = 0.9 to 1.1, "++" > 1.1, "+++" > 1.5, "++++" > 3
[2]Amino Acid Differences does not include Histidine tag at C-terminus Example 4: Comparison of Variant with and without His Tag The linker and C-terminus His tag from SEQ ID NO: 1362 was removed to generate SEQ ID NO: 2332. SEQ ID NO: 1362 was produced using the shake flask purification method in Example 2, and SEQ ID NO: 2332 was produced as described in Example 7, below. Equal protein concentration (measured by protein content and purity) of SEQ ID NO: 1362 and SEQ ID NO: 2332 were characterized in the following in vitro assays: unchallenged activity, activity after 1 hour pre-incubation at pH 3.5, activity after 1 hour pre-incubation at pH 4, activity after 1 hour pre-incubation at pH 3.5 with 1.5 g/L pepsin, activity after 1 hour pre-incubation at pH 4 with 1.5 g/L pepsin, activity after 1 hour pre-incubation with 5 mM taurocholate, and for autolysis stability after 1 day incubation at 37° C. as described in Example 2. These experiments were tested in either triplicate or sextuplicate. Under the various conditions tested, SEQ ID NO: 1362 and SEQ ID NO: 2332 were found to have similar properties, as shown in Table 4.

TABLE 4

Activity after challenges for SEQ ID NO: 1362 and SEQ ID NO: 2332[1]

| Assays | SEQ ID NO: 1362 | SEQ ID NO: 2332 |
|---|---|---|
| Unchallenged Activity | 1.00 ± 0.03 | 1.00 ± 0.10 |
| pH 3.5 Pre-incubation | 0.45 ± 0.06 | 0.45 ± 0.03 |
| pH 4.0 Pre-incubation | 0.91 ± 0.02 | 0.99 ± 0.07 |
| pH 3.5 Pepsin Pre-Incubation | 0.89 ± 0.03 | 0.95 ± 0.08 |
| pH 4 Pepsin Pre-Incubation | 0.93 ± 0.04 | 0.98 ± 0.07 |
| Taurocholate Pre-incubation | 0.85 ± 0.06 | 0.97 ± 0.08 |
| Autolysis Stability | 0.26 ± 0.08 | 0.34 ± 0.09 |

[1]Activity values are shown as normalized value ± standard deviation to the unchallenged activity for each SEQ ID Example 5: Generation and Validation of a Surgical Model of Exocrine Pancreatic Insufficiency in Miniature Swine A surgical model of exocrine pancreatic insufficiency (EPI) was produced in Sinclair™ miniature swine by pancreatic duct ligation. Starting 7 days prior to surgery and continuing throughout the experiment, female miniature swine, aged 7-8 months and between 19.9-26.2 kg, were fed a High Fat Diet (HFD; Sinclair Standard diet S-9 [19% protein, 5.8% fat] mixed 10:1, w/w, with BERTOLLI® olive oil, and a pre-portioned 3.9 oz cup of unsweetened MOTT'S® apple sauce) once a day. Total fecal output over 24 hours was collected on 3 consecutive days immediately prior to surgery, and on days 15, 16, and 17 post-surgery. The daily total fecal collections from each animal were prepared for subsequent analytics by adding a volume of distilled water at approximately 1.5× the fecal net weight, homogenizing, dividing into 3×50 mL aliquots, and freezing at −20° C. until analysis. The model was validated by measuring the fat content (by modified Van de Kamer method; See, Van de Kamer, in Seligson (ed) Standard Methods of Clinical Chemistry, volume 2, Academic Press, New York, NY (1958), pp. 34-39), and nitrogen content (Kjeldahl total nitrogen by Vario Max CN machine by combustion method; See, Watson et al., in Peters et al. (eds.) Recommended Methods of Manure Analysis, Univ. of Wisconsin Cooperative Extension Publishing, Publication No. A3769. Madison, WI. [2003], p. 18-24), in fecal samples, and assessing the percent change before and after surgery. Prior to surgery, fecal matter collected from healthy miniature swine contained low levels of fat (0.86 g±0.1 g SD/100 g fecal matter) and nitrogen (0.43 g±0.28 g SD/100 g fecal matter). After surgery fecal content increased to 3.75 g fat±0.05 g SD/100 g fecal matter (a 336% increase) and 0.72 g nitrogen±0.04 g SD/100 g fecal matter (a 67% increase), thus validating this surgical model for EPI studies.

Example 6: In Vivo Characterization of Protease Variant in a Miniature Swine Model of Exocrine Pancreatic Insufficiency Validated Sinclair™ miniature swine surgical models of EPI (n=6 female, aged 8-9 months) were carried forward into in vivo studies to evaluate an engineered protease variant (SEQ ID NO: 756) co-dosed with an engineered lipase (SEQ ID NO: 1364) for maintenance. Starting 28 days prior to dosing (18 days post-surgery), EPI miniature swine were switched from once daily HFD to once daily high protein diet (HPD; Sinclair High Protein diet S-11 [23.79% protein, 5.65% fat] mixed with a pre-portioned 3.9 oz cup of unsweetened MOTT'S® apple sauce) in preparation for efficacy studies. During dosing days, the meal was prepared for each animal sequentially to ensure minimal ex vivo enzyme interaction with dietary fats and proteins prior to ingestion. In brief, S-11 miniature swine feed was portioned first in a clean feed bowl. Next, enzymes (0.045 g lyophilized lipase powder and 3.0 g of lyophilized protease powder, which corresponded to 44,000 U lipase and 465,000 U protease, respectively) were mixed into a 3.9 oz. cup of unsweetened applesauce. (The Units of lipase and protease enzymes were determined by the United States Pharmacopeia (USP) assays.) The enzyme-applesauce mixture was then transferred to the S-11 miniature swine feed and quickly mixed. Finally, the feed bowl was immediately offered to the miniature swine before moving on to the next preparation. After 2 hours, the feed bowl was removed; the animals having consumed the entire meal within 30 minutes or less. The dosing phase lasted a duration of 14 days. Total fecal output over 24 hours was collected on 3 consecutive days immediately prior to dosing start, and on days 6, 7, 8, and 12, 13, 14 during the dosing phase. Fecal samples were prepared by adding a volume of distilled water at approximately 1.5× the fecal net weight to each daily total fecal collection, homogenizing, dividing into 3×50 mL and freezing at −20° C. until analysis, discarding the rest. Analytics for nitrogen content in fecal material were completed as described for model validation above. Prior to dosing nitrogen content was 0.82 g±0.11 g SD/100 g fecal matter, which was not significantly different at 1- or 2-weeks post-dose (0.75 g±0.08 g SD/100 g fecal matter and 0.78 g±0.07 g SD/100 g fecal matter, respectively). As an alternative assessment of protease efficacy, amino acids were quantified in pre- and post-dose blood serum samples. A prior study in Gottingen miniature swine had shown differential increases in post-prandial amino acids in plasma in response to various fed protein sources (Hagemeister et al., J. Nutrition, 1990, 120: 1305-1311), therefore this measure may be useful to evaluate improved protease activity when dosed with a protein-containing meal. Samples were obtained 2 hours pre-prandial (Day −6 pre-dose and on Dosing Day 12), and 0.75, 1.25, 1.75, 2.25, 4.25, 8.25, and 24* hours post-prandial (Day −3 pre-dose and on Dosing Day 14; *24 hour time point actually obtained the following day prior to feeding). At the designated time point (±10% nominal time), 3 mL of whole blood was collected via direct venipuncture of the jugular vein or other appropriate vessel. Blood was allowed to clot for ~30 minutes at room temperature before being centrifuged for ~15 minutes at ~3000 RPM at ~4° C. The serum samples were aliquoted into pre-labeled primary and backup cryovials and stored at ~70° C. until analysis. Serum samples were prepared for amino acid quantification as follows: 200 uL serum was measured into 1.5 mL Eppendorf centrifuge vial, 6% sulfosalicylic acid was added in 1:1 (V:V) ratio, the mixture was homogenized thoroughly. After sitting at 4° C. for 10 minutes, the mixture was spun down under refrigeration (4° C.) for 15 minutes at 16.0 ref. Then, 25 uL supernatant was loaded on fully automated Biochrom 30+ amino acid analyzer (UK), which uses a cation exchange column to separate the individual amino acid and post-column ninhydrin colorimetric for quantification. Amino acid standards for bio-fluids were purchased from Sigma. Norleucine was added as an internal standard for QC. Data analysis was carried out in GraphPad Prism 7 (GraphPad). Pre- and post-dose pre-prandial values were not significantly different. Eight out of the nine essential amino acids (EAA; methionine, leucine, valine, isoleucine, phenylalanine, histidine, lysine, and threonine) were significantly elevated in post-prandial serum samples post-dose compared to pre-dose; the ninth (tryptophan) also showed an increase post-dose, though statistical significance was not achieved. FIG. 1 shows that the sum total of essential amino acids was significantly increased post-prandially after 14 days of dosing with SEQ ID NO: 756. Additionally, five conditionally essential amino acids (tyrosine, glycine, proline, serine, and ornithine) were significantly elevated post-prandially following 14 days of protease dosing, and a sixth (arginine) showed some increase, though statistical significance was not achieved.

Example 7: In Vivo Characterization of Protease Variant in a Miniswine Model of Exocrine Pancreatic Insufficiency (EPI)

The expression constructs for engineered lipase variant SEQ ID NO: 1364 and engineered protease variant SEQ ID NO:2332 were transformed into *E. coli*, and the resulting strain was fermented in a fed-batch 15 L format. At the conclusion of the fermentation phase, cells were harvested by centrifugation.

Harvested cells were resuspended and lysed by rapid pressure change. The whole cell lysate was clarified by flocculation followed by centrifugation. The soluble target protease was then reversibly precipitated out of solution by the addition of kosmotropic salts, and collected by centrifugation. The collected protease precipitate was resolubilized. Tangential-flow filtration was performed to concentrate the resolubilized protease and buffer exchange into the formulation buffer. The resulting retentate was freeze-dried to obtain an enzyme powder.

Validated Sinclair miniswine surgical models of EPI (n=4 females, 47 kg BW average, aged 2.5-3 years and n=8 females, 31.6 kg BW average, aged 1.3 years) were carried forward into in vivo studies to evaluate the engineered protease variant, co-dosed with the engineered lipase for maintenance. Starting 21 days prior to dosing, Viokase® treatment was withdrawn to induce disease state and high protein diet was fed once daily, [HPD; Sinclair High Protein diet S-11 (23.79% protein, 5.65% fat) mixed with a pre-portioned 3.9 oz cup of unsweetened MOTT'S® apple sauce], in preparation for efficacy studies. During dosing days, the meal was prepared for each pig sequentially to ensure minimal ex vivo drug interaction with dietary fats and proteins prior to ingestion. In brief, S-11 miniswine feed appropriate for pig weight (either 600 g or 450 g) was portioned first in a clean feed bowl. Next, enzymes (liquid formulated SEQ ID NO: 1364, and lyophilized SEQ ID NO: 2332) were mixed into a 3.9 oz. cup of unsweetened applesauce, in order to allow the acidic pH to protect against early enzyme activation. Dosing for lipase (1333 U/g fat) was based upon USP lipase units, and determined by the USP assay (United States Pharmacopeia and National Formulary (USP 42-MF 37). Rockville, MD: United States Pharmacopeial Convention; 2016), and total calculated fat provided in the meal. Dosing for protease (8.95 mg enzyme/g protein) was calculated based upon enzyme content in lyophilized power, determined by SDS-PAGE, and total calculated protein provided in the meal. Total Units dosed were 33892 U or 45189 U lipase and 137 U or 183 U protease, which varied due to miniswine body weight corresponding to amount of S-11 diet provided. The enzyme-applesauce mixture was then transferred to the S-11 miniswine feed and quickly mixed. Once prepared, the feed bowl was immediately offered to the miniswine before moving on to the next preparation. After 2 hours, the feed bowl was removed; pigs having consumed the entire meal within 30 minutes or less. Study utilized a crossover design; dosing phases lasted a duration of 14 days, separated by a 14 day washout with once-daily HPD. Total fecal output over 24 hours was collected on 3 consecutive days during acclimation immediately prior to dosing start, and on days 12, 13, 14 (dosing phase 1), 27, 28, 29 (washout), and 41, 42, 43 (dosing phase 2). Fecal samples were prepared by adding a volume of distilled water at approximately 1.5× the fecal net weight to each daily total fecal collection, homogenizing, dividing into 3×50 mL and freezing at −20° C. until analysis, discarding the rest. Fat (by modified Van de Kamer method; See, Van de Kamer, in Seligson (ed), Standard Methods of Clinical Chemistry, volume 2, Academic Press, New York, NY [1958], pp. 34-39) and nitrogen (Kjeldahl total nitrogen by Vario Max CN machine by combustion method; See, Watson et al., in Peters et al. (eds.) Recommended Methods of Manure Analysis, Univ. of Wisconsin Cooperative Extension Publishing, Publication No. A3769. Madison, WI. [2003], p. 18-24) content were quantified in fecal matter. Prior to dosing phases, nitrogen content was 0.634 g±0.09 g SD/100 g fecal matter (acclimation) and 0.834±0.14 g SD/100 g fecal matter (washout), which was not significantly different post-phase 1 or phase 2 dosing (0.78 g±0.14 g SD/100 g fecal matter and 0.872 g±0.17 g SD/100 g fecal matter, respectively). As an alternative assessment of protease efficacy, amino acids were quantified in pre- and post-dose blood serum samples. A prior study in Gottingen miniswine had shown differential increases in post-prandial amino acids in plasma, in response to various fed protein sources (Hagemeister, et al., The Journal of Nutrition, 1990, 120(11): 1305-1311). On days −1, 14, 27, and 42 samples were obtained 2 hours pre-prandial, and 1, 1.5, 2, 2.5, 4.5, 6.5, and 8.5 hours post-prandial. At the designated time point (±10% nominal time), 3 mL of whole blood was collected via direct venipuncture of the jugular vein or other appropriate vessel. Blood was allowed to clot for ~30 minutes at room temperature before being centrifuged for ~15 minutes at ~3000 RPM at ~4° C. The serum samples were aliquoted into pre-labeled primary and backup cryovials and stored at ~70° C. until analysis. Serum samples were prepared for amino acid quantification by dilution with acetonitrile containing 0.1% formic acid, centrifugation at 4,000 RPM for 10 minutes, and transfer of supernatant for analysis by LC-MS/MS (HILIC). Data analysis was carried out in GraphPad Prism 7 (GraphPad Software, San Diego, CA). Pre- and post-dose pre-prandial values were not significantly different, AUC for five out of the nine essential amino acids (EAA; leucine, valine, isoleucine, tryptophan, and lysine) were significantly elevated in post-prandial serum samples post-dose compared to pre-dose. Additionally, AUC for tyrosine and arginine were significantly elevated post-prandially following 14 days of protease dosing.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention.

SEQUENCE LISTING (2332 sequences)

SEQ ID NO: 1 - DNA, 1998 bp, Artificial Sequence
  Wild type serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 2 - protein, 666 aa, Artificial Sequence
  Wild type serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 3 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacctgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 4 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNLGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 5 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacgcgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 6 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNAGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 7 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacactggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 8 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNTGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 9 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacatgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 10 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNMGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 11 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacgggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 12 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNGGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 13 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtctgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 14 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRLSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 15 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtatggcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 16 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGMANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 17 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcaccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaactatggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 18 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINYGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 19 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgatggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 20 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPMDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 21 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcggagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 22 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 23 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacagtccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 24 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNSPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 25 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaaccgtccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 26 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNRPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 27 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtagggcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 28 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGRANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 29 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgtgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 30 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNVPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 31 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacaagaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 32 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNKNQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 33 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 34 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 35 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 36 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 37 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgggccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatgttcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 38 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNGPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDVQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 39 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaaggcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 40 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGKANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 41 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgatcatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccactgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcaggtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 42 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLIIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSRYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 43 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcggcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 44 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 45 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagccgttatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 46 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSRYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 47 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagccgcggtaccggtaccaccatcgcgatcattgacgatggcatggacctggatcacccggaatttcgcaccgcgggtaaaattgtggcgccgcgtgacgttacccgtaaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttctgccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 48 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSRGTGTTIAIIDDGMDLDHPEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVLPMLLHNREGAATDNIKKTYDEVNAPGLAACKGKSPQGTWALEVADKAQRDIGKMRSFTLELGFEQPS

SEQ ID NO: 49 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcatttcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 50 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIISRNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 51 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacgtgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 52 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNVGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 53 - DNA, 1998 bp, Artificial Sequence
  Variant of serine endopeptidase from Microcoleus sp. PCC 7113
atggtgaccgtgcgttatggtggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgggccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 54 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNGPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 55 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtacgggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 56 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 57 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgaaccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtggttgacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 58 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIANRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVVDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 59 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 60 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 61 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattgacgcggatgcgaacgtggaagcggcgtggagcctgagccgcggtaccggtaccaccatcgcgatcattgacgatggcatggacctggatcacgaggaatttcgtaccgcgggtaaaattgtggcgccgcgtgacgttacccgtaaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgcgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaacgatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 62 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAIDADANVEAAWSLSRGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPINDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 63 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcggaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 64 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRRTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 65 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgtggcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 66 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNAWQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 67 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattgacgcggatgcgaacgtggaagcggcgtggagcctgagcaatggtaccggtaccaccatcgcgatcattgacgatggcatggacctggatcacccggaatttcgcaccgcgggtaaaattgtggcgccgcgtgacgttacccgtaaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgcgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttctgccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 68 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAIDADANVEAAWSLSNGTGTTIAIIDDGMDLDHPEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVLPMLLHNREGAATDNIKKTYDEVNAPGLAACKGKSPQGTWALEVADKAQRDIGKMRSFTLELGFEQPS

SEQ ID NO: 69 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcggtcaacccgaatctgcgttgggaccaggttcgtgagatcattaagcaaagctgcgaccgtatcgatcagcaaggtggcaactacgatgcgagcggtcgtagcccgttctacggttatggccgtatgaacgcgcgcaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 70 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIAVNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 71 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagccgcggtaccggtaccaccatcgcgatcattgacgatggcatggacctggatcacgaggaatttcgcaccgcgggtaaaattgtggcgccgcgtgacgttacccgtcaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgcgttggttacaacccgggtaacgcgaaccagggtgatgcggcgggtaactataccaacagctttggtggcaccagcagcgcgtgcccgggtgcggcgggtgtggcggcgctgatcatttcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaagccggagcaggaaagcccggttagcatctttaccgcggtgcaagacgttccgattaacgatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 72 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSRGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIISRNPNLRWDQVREIIKQSCDRIDQQGGNYDASGRSPFYGYGRMNARKAVELAKPEQESPVSIFTAVQDVPINDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 73 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggttgggcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 74 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGWANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 75 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtgctggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 76 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRAGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 77 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgcgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaagccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 78 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAKPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 79 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaatctgcgttgggaccaggttcgtgagatcattaagcagagctgcgaccgtatcgatcagcaaggtggcaactacgatgcgagcggtcgtagcccgttctacggttatggccgtatgaacgcgctgaaggcggtggaactggcgatgccggagcaggaaagcccggttagcatctttacggcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 80 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNALKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 81 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtttgggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 82 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRLGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 83 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacatttggaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 84 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIWKTYDEVNAPGLAACKGKSPQGTWALEVADKAQRDIGKMRSFTLELGFEQPS

SEQ ID NO: 85 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaatggtaccggtaccaccatcgcgatcattgacgatggcatggacctggatcacgaggaatttcgtaccgcgggtaaaattgtggcgccgcgtgacgttacccgtcaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcatttcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaagccggagcaggaaagcccggttagcatctttaccgcggtgcaagacgttccgattaacgatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 86 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIISRNPNLRWDQVREIIKQSCDRIDQQGGNYDASGRSPFYGYGRMNARKAVELAKPEQESPVSIFTAVQDVPINDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 87 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcatagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 88 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRHSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 89 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgcgttggttacaacccgggtaacgtgaaccagggtgatgcggcgggtaactataccaacagctttggtggcaccagcagcgcgtgcccgggtgcggcgggtgtggcggcgctgatcatttcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 90 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNVNQGDAAGNYTNSFGGTSSACPGAAGVAALIISRNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 91 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 92 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 93 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcggctccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 94 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAAPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 95 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgtgtaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 96 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIACTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 97 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggaggtggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 98 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEVESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 99 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcggataccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 100 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIADTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 101 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaactgggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 102 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNWVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 103 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtttgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 104 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPFDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 105 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtgggggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 106 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 107 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaagggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 108 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGKGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 109 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagctattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaatgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaatcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcgcagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaagcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 110 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKRSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 111 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaaactattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaatcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 112 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQTINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDPQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 113 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaagccggagcaggaaagcccggttagcatctttaccgcggtgcaagacgttccgattaacgatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 114 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAKPEQESPVSIFTAVQDVPINDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 115 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagggggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 116 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEGESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 117 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaatcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgcccgtcgaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccggatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 118 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPDLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 119 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtgcgggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcactcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 120 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGAGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAITQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 121 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattccgaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 122 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIPKTYDEVNAPGLAACKGKSPQGTWALEVADKAQRDIGKMRSFTLELGFEQPS

SEQ ID NO: 123 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaatccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 124 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELANPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 125 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcattatgcgtagctttaccctggaactgggctttgagcaaccgagc

SEQ ID NO: 126 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGIMRSFTLELGFEQPS

SEQ ID NO: 127 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagctattaacgcggatgcgaacgtggaagcggcgtggagcctgagcaacggtgcgggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaatcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 128 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGAGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 129 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtcagggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 130 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRQGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 131 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 132 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 133 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtacgggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcggtcaacccgaatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 134 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIAVNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 135 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaagccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 136 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAKPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 137 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattgggaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 138 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIGKTYDEVNAPGLAACKGKSPQGTWALEVADKAQRDIGKMRSFTLELGFEQPS

SEQ ID NO: 139 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattactaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 140 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNITKTYDEVNAPGLAACKGKSPQGTWALEVADKAQRDIGKMRSFTLELGFEQPS

SEQ ID NO: 141 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcggagccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 142 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAEPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 143 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagctattaacgcggatgcgaacgtggaagcggcgtggagcctgagcaacggtacgggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaatcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttacggcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 144 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 145 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaatggtaccggtaccaccatcgcgatcattgacgatggcatggacctggatcacgaggaatttcgcaccgcgggtaaaattgtggcgccgcgtgacgttacccgtcaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttctgccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 146 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVLPMLLHNREGAATDNIKKTYDEVNAPGLAACKGKSPQGTWALEVADKAQRDIGKMRSFTLELGFEQPS

SEQ ID NO: 147 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagctattaacgcggatgcgaacgtggaagcggcgtggagcctgagcaacggtgcgggtaccaccatcgcgatcattgacgatggcatggacctggatcacgaggaatttcgtaccgcgggtaaaattgtggcgccgcgtgacgttacccgtcagaccgatgagccgcatccgcgtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgcccgtcgaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcagagctgcgaccgtatcgatcaacaaggtggcaactacgatgcgagcggtcgtagcccgttctacggttatggccgtatgaacgcgcgcaaggcggtggaactggcgatgccggagcaggaaagcccggttagcatctttcgtgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaagcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 148 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGAGTTIAIIDDGMDLDHEEFRTAGKIVAPRDVTRQTDEPHPRNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 149 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagctattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaatgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcactcaaggccgtggcggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgcccgtcgaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccggatctgcgttgggaccaggttcgtgagatcattaagcagagctgcgaccgtatcgatcagcaaggtggcaactacgatgcgagcggtcgtagcccgttctacggttatggccgtatgaacgcgcgcaaggcggtggaactggcgatgccggagcaggaaagcccggttagcatctttacggcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 150 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAITQGRGGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPDLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 151 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtgcgggtaccaccatcgcgatcattgacgatggcatggacctggatcacgaggaatttcgtaccgcgggtaaaattgtggcgccgcgtgacgttacccgtcagaccaacgagctgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 152 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGAGTTIAIIDDGMDLDHEEFRTAGKIVAPRDVTRQTNELRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 153 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 154 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 155 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaacgagggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 156 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINEGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 157 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattgcgaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 158 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIAKTYDEVNAPGLAACKGKSPQGTWALEVADKAQRDIGKMRSFTLELGFEQPS

SEQ ID NO: 159 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcatttcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 160 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIISRNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 161 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaatggtaccggtaccaccatcgcgatcattgacgatggcatggacctggatcacgaggaatttcgcaccgcgggtaaaattgtggcgccgcgtgacgttacccgtaaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcctgaccccgggtatttggaccaccgatcgtagcggccgcgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 162 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAADNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSLTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 163 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaactggggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 164 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINWGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 165 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtggcggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 166 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVADVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 167 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccggatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 168 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPDLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 169 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaaactattaacgcggatgcgaacgtggaagcggcgtggagcctgagcaacggtacgggtaccaccatcgcgatcattgacgatggcatggacctggatcacgaggaatttcgtaccgcgggtaaaattgtggcgccgcgtgacgttacccgtcagaccaatgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaatcaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccggatctgcgttgggaccaggttcgtgagatcattaagcaaagctgcgaccgtatcgatcagcaaggtggcaactacgatgcgagcggtcgtagcccgttctacggttatggccgtatgaacgcgctgaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 170 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQTINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPDLRWDQVREIIKQSCDRIDQQGGNYDASGRSPFYGYGRMNALKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 171 - DNA, 1998 bp, Artificial Sequence
  Variant of serine endopeptidase from Microcoleus sp. PCC 7113
atggtgaccgtgcgttatggtggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggaggaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 172 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 173 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaatgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgcccgtcgaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcggtcaacccggatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaagcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 174 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIAVNPDLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 175 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttaagaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 176 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFKTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 177 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtgcgggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcggtcaacccgaatctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 178 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGAGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIAVNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 179 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcacgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggaggatgaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 180 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSTQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEDESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 181 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagccgcggtaccggtaccaccatcgcgatcattgacgatggcatggacctggatcacgaggaatttcgtaccgcgggtaaaattgtggcgccgcgtgacgttacccgtcaaaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcctgaccccgggtatttggaccaccgatcgtagcggccgcgttggttacaacccgggtaacgcgaaccagggtgatgcggcgggtaactataccaacagctttggtggcaccagcagcgcgtgcccgggtgcggcgggtgtggcggcgctgatcatttcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgaagccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 182 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSRGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSLTPGIWTTDRSGRVGYNPGNANQGDAAGNYTNSFGGTSSACPGAAGVAALIISRNPNLRWDQVREIIKQSCDRIDQQGGNYDASGRSPFYGYGRMNARKAVELAKPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 183 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattgataaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 184 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIDKTYDEVNAPGLAACKGKSPQGTWALEVADKAQRDIGKMRSFTLELGFEQPS

SEQ ID NO: 185 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcggatccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 186 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELADPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 187 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaatgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaacccgggtaacgcgaaccagggtgatgcggcgggtaactataccaacagctttggtggcaccagcagcgcgtgcccgggtgcggcgggtgtggcggcgctgatcattgcgcgtaacccggatctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgctggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 188 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPDLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLLAPVEMGVDPMLLHNREGAATDNIKKTYDEVNAPGLAACKGKSPQGTWALEVADKAQRDIGKMRSFTLELGFEQPS

SEQ ID NO: 189 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 190 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 191 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagccgctatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 192 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSRYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 193 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 194 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 195 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcttatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 196 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 197 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgaacgatccgctgcacaaccaggtggttccgctgccggacagcacccgtctggcgatggatttcgcgatcactcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 198 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAITQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 199 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 200 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 201 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgtgggatccgctgcacaaccaggtggttccgctgccggacagcacccgtctggcgatggatttcgcgatcaatcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaaggcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 202 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGKANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 203 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 204 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 205 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 206 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFRAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 207 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcttatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 208 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 209 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagccgctatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgatgccggagcaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 210 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSRYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDPQGGNYDASGRSPFYGYGRMNARKAVELAMPEQESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 211 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgaagccggaggaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 212 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDPQGGNYDASGRSPFYGYGRMNARKAVELAKPEEESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 213 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgtgggatccgctgcacaaccaggtggttccgctgccggacagcacccgtctggcgatggatttcgcgatcaatcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 214 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 215 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagccgctatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggaggaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 216 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSRYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 217 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaactgggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggaggaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 218 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPNDPRHNWVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 219 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcttatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggaggaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 220 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIAVNPNLRWDQVREIIKQSCDRIDQQGGNYDASGRSPFYGYGRMNARKAVELAMPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 221 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggaggaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 222 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIAVNPNLRWDQVREIIKQSCDRIDQQGGNYDASGRSPFYGYGRMNARKAVELAMPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 223 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcggatccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 224 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDPQGGNYDASGRSPFYGYGRMNARKAVELADPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 225 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaaccgtccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 226 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNRPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIAVNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 227 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaactgggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcttatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgatgccggagcaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 228 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPLHNWVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDPQGGNYDASGRSPFYGYGRMNARKAVELAMPEQESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 229 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgaagccggaggaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 230 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAKPEEESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 231 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgaagccggaggaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 232 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIAVNPNLRWDQVREIIKQSCDRIDPQGGNYDASGRSPFYGYGRMNARKAVELAKPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 233 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaaccgtccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggaggaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 234 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNRPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIAVNPNLRWDQVREIIKQSCDRIDQQGGNYDASGRSPFYGYGRMNARKAVELAMPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 235 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaactgggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 236 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNWVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 237 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgaagccggaggaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 238 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIAVNPNLRWDQVREIIKQSCDRIDPQGGNYDASGRSPFYGYGRMNARKAVELAKPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 239 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaactgggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 240 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPLHNWVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 241 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgaacgatccgctgcacaaccaggtggttccgctgccggacagcacccgtctggcgatggatttcgcgatcaatcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattgctaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 242 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFRAVEDVPIKDLETSTLTLAIANTDLIKSIKVSVDIEHSYIGDLVVTLKAPVEMGVDPMLLHNREGAATDNIAKTYDEVNAPGLAACKGKSPQGTWALEVADKAQRDIGKMRSFTLELGFEQPS

SEQ ID NO: 243 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgaacgatccgctgcacaaccaggtggttccgctgccggacagcacccgtctggcgatggatttcgcgatcaatcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattgctaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 244 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFRAVQDVPIKDLETSTLTLAIANTDLIKSIKVSVDIEHSYIGDLVVTLKAPVEMGVDPMLLHNREGAATDNIAKTYDEVNAPGLAACKGKSPQGTWALEVADKAQRDIGKMRSFTLELGFEQPS

SEQ ID NO: 245 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcggatccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 246 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELADPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 247 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcggatccggaggaggaaagcccggttagcatctttaccgcggtgcaagacgtgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 248 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIAVNPNLRWDQVREIIKQSCDRIDPQGGNYDASGRSPFYGYGRMNARKAVELADPEEESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 249 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgaacgatccgctgcacaaccaggtggttccgctgccggacagcacccgtctggcgatggatttcgcgatcaatgagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaatgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 250 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINEGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 251 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgtgggatccgctgcacaaccaggtggttccgctgccggacagcacccgtctggcgatggatttcgcgatcactcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaatgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 252 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAITQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 253 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgtgggatccgctgcacaaccaggtggttccgctgccggacagcacccgtctggcgatggatttcgcgatcactgagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaatgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattgctaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 254 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAITEGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVEDVPIKDLETSTLTLAIANTDLIKSIKVSVDIEHSYIGDLVVTLKAPVEMGVDPMLLHNREGAATDNIAKTYDEVNAPGLAACKGKSPQGTWALEVADKAQRDIGKMRSFTLELGFEQPS

SEQ ID NO: 255 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaaccgtccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcttatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgatgccggagcaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 256 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNRPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIAVNPNLRWDQVREIIKQSCDRIDPQGGNYDASGRSPFYGYGRMNARKAVELAMPEQESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 257 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgtgggatccgctgcacaaccaggtggttccgctgccggacagcacccgtctggcgatggatttcgcgatcaatcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttacggcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 258 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 259 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgaacgatccgctgcacaaccaggtggttccgctgccggacagcacccgtctggcgatggatttcgcgatcactgagggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 260 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAITEGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 261 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaaccgtccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcttatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcggtaaacccgaacctgcgttgggaccaggttcgtgagatcattaagcaaagctgcgaccgtatcgatccacaaggtggcaactacgatgcgagcggtcgtagcccgttctacggttatggccgtatgaacgcgcgtaaggcggtggaactggcgatgccggagcaggaaagcccggttagcatctttaccgcggtgcaagacacgccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 262 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNRPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIAVNPNLRWDQVREIIKQSCDRIDPQGGNYDASGRSPFYGYGRMNARKAVELAMPEQESPVSIFTAVQDTPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 263 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgtgggatccgctgcacaaccaggtggttccgctgccggacagcacccgtctggcgatggatttcgcgatcactcagggccgtaatggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 264 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPWDPLHNQVVPLPDSTRLAMDFAITQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 265 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcggataacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtcgtgcgaaccagggtgatgcggcgggtaactataccaacagctttggtggcaccagcagcgcgtgcccgggtgcggcgggtgtggcggcgctgatcattgcgcgcaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 266 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAADNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGRANQGDAAGNYTNSFGGTSSACPGAAGVAALIIARNPNLRWDQVREIIKQSCDRIDQQGGNYDASGRSPFYGYGRMNARKAVELAMPEQESPVSIFRAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 267 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtcagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcagaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcagcaaggtggcaactacgatgcgagcggtcgtagcccgttctacggttatggccgtatgaacgcgcgtaaggcggtggaactggcgatgccggagcaggaaagcccggttagcatctttcgtgcggtggaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaaaaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 268 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRQTNEPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFRAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 269 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaattgcagcgtgacattggcaagatgcgtagctttaccctggaactgggctttgagcaaccgagc

SEQ ID NO: 270 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKLQRDIGKMRSFTLELGFEQPS

SEQ ID NO: 271 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagttcagcgtgacattggcaagatgcgtagctttaccctggaactgggctttgagcaaccgagc

SEQ ID NO: 272 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKVQRDIGKMRSFTLELGFEQPS

SEQ ID NO: 273 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 274 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 275 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccagggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 276 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIQGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 277 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcacgggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 278 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTITGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 279 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttaggatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 280 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVRIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 281 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaagtgagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 282 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLEVSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 283 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 284 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 285 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgagcgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtggaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 286 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPSDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 287 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccggggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 288 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 289 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgttctggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 290 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRSGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 291 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 292 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 293 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggcttttagcaaccgagc

SEQ ID NO: 294 - protein, 662 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGF

SEQ ID NO: 295 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctgaagcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 296 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLKHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 297 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagtgggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 298 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEWESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 299 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggcggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 300 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPAEMGVDPMLLHNREGAATDNIKKTYDEVNAPGLAACKGKSPQGTWALEVADKAQRDIGKMRSFTLELGFEQPS

SEQ ID NO: 301 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaagagagc

SEQ ID NO: 302 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQES

SEQ ID NO: 303 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagccggaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 304 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSRKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 305 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtgggctctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 306 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWALSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 307 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtcttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 308 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 309 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcgagctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 310 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSELTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 311 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtggaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 312 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 313 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagtgggaaagcccggttagcatctttaccgcggtggaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 314 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEWESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 315 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagggggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 316 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQGGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 317 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagtgggaaagcccggttagcatctttaccgcggtggaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 318 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEWESPVSIFTAVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 319 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttatgcaaccgagc

SEQ ID NO: 320 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFMQPS

SEQ ID NO: 321 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccagggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 322 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTRVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 323 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccattgtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 324 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 325 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgagccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcgtagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagtgggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 326 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRRSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEWESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 327 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttgggatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 328 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVGIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 329 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttattatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 330 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVIIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 331 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagctagtttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 332 - protein, 541 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVS

SEQ ID NO: 333 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagtggaaaagcccgcaaggtacctgggcgctggaagttgcggacaaagcgcagcgtgacattggcaagatgcgtagctttaccctggaactgggctttgagcaaccgagc

SEQ ID NO: 334 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKWKSPQGTWALEVADKAQRDIGKMRSFTLELGFEQPS

SEQ ID NO: 335 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttacctaggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 336 - protein, 544 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFT

SEQ ID NO: 337 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagctaggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 338 - protein, 538 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQES

SEQ ID NO: 339 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacgaaccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaacgatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtccgagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaggaaagcccggttagcatctttaccgcggtgcaagacgttccgattaaagatctggaatagagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 340 - protein, 555 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNEPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLE

SEQ ID NO: 341 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcaaggtacctgggcgctggaagttgcggacaaagtgcagcgtgacattggcaagatgcgtagctttaccctggaactgggctttgagcaaccgagc

SEQ ID NO: 342 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNANQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 343 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaacggggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 344 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQRGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 345 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatttggtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 346 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDLVNAPGLAACKGKSPQGTWALEVADKAQRDIGKMRSFTLELGFEQPS

SEQ ID NO: 347 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatcaggtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 348 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDQVNAPGLAACKGKSPQGTWALEVADKAQRDIGKMRSFTLELGFEQPS

SEQ ID NO: 349 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacacgggcaagatgcgtagctttaccctggaactgggctttgagcaaccgagc

SEQ ID NO: 350 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDTGKMRSFTLELGFEQPS

SEQ ID NO: 351 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 352 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 353 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggataccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 354 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLDTSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 355 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacctgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 356 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNLNQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 357 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagattattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgattcggtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 358 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDSVNAPGLAACKGKSPQGTWALEVADKAQRDIGKMRSFTLELGFEQPS

SEQ ID NO: 359 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctgggtaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 360 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLGTSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 361 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcgagctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagtgcagcgtgacattggcaagatgcgtagctttaccctggaactgggctttgagcaaccaagc

SEQ ID NO: 362 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSELTLAIANTDLIKSIKVSVDIEHSYIGDLVVTLKAPVEMGVDPMLLHNREGAATDNIKKTYDEVNAPGLAACKGKSPQGTWALEVADKVQRDIGKMRSFTLELGFEQPS

SEQ ID NO: 363 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctgcttaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 364 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLLTSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 365 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaagggagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 366 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLEGSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 367 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtgggaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 368 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRGTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 369 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttattatctttacccgcgtggaggacgttccgattaaagatctggaaaccagcgagctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagtgcagcgtgacattggcaagatgcgtagctttaccctggaactgggctttgagcaagaaagc

SEQ ID NO: 370 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQAGGNYDASGRSPFYGYGRMNARKAVELAMPEWESPVIIFTRVEDVPIKDLETSELTLAIANTDLIKSIKVSVDIEHSYIGDLVVTLKAPVEMGVDPMLLHNREGAATDNIKKTYDEVNAPGLAACKGKSPQGTWALEVADKVQRDIGKMRSFTLELGFEQES

SEQ ID NO: 371 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtcgggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagtgggaaagcccggttagtatctttaccatcgtggaggacgttccgattaaagatctggaaaccagcactctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 372 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRRAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEWESPVSIFTIVEDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 373 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgttcgggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 374 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRSGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 375 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgatgccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 376 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPMPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 377 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgagtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 378 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPSPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 379 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgttggttacaaccctggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacaaggtggcaactacgatgcgagcggtcgtagcccgttctacggttatggccgtatgaacgcgcgtaaggcggtggaactggcgatgccggagcaagaaagcccggttagcatctttaccgcggtgcaagacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcaaggtacctgggcgctggaagttgcggacaaagcgcagcgtgacattggcaagatgcgtagctttaccctggaactgggctttgagcaaccgagc

SEQ ID NO: 380 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNANQGDAAGNYTNSFGGTSSACPGAAGVAALIIARNPNLRWDQVREIIKQSCDRIDQQGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 381 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagc

SEQ ID NO: 382 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 383 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtcacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaactgtgtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggcggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaaacgctggggaccagcacgctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagc

SEQ ID NO: 384 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGHVGASGVAPGARLMPIRLASGLGSQAEADAFVWAAQNGADVISCSWGPPDGVWYNPWDPRHNCVVPLPDSTRLAMDYAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKTLGTSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 385 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggcggcggttacgatgcgagcggtcgtagcccgttctacggttatggccgtatgaacgcgcgtaaggcggtggaactggcgatgccggagtgggaaagcccggttatcatctttaccatcgtgcaggacgttccgattaaaacgctggagaccagcacgctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagc

SEQ ID NO: 386 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNANQGDAAGNYTNSFGGTSSACPGAAGVAALIIARNPNLRWDQVREIIKQSCDRIDQAGGGYDASGRSPFYGYGRMNARKAVELAMPEWESPVIIFTIVQDVPIKTLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 387 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtctggttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggcggcggttacgatgcgagcggtcgtagcccgttctacggttatggccgtatgaacgcgcgtaaggcggtggaactggcgatgccggagtgggaaagcccggttatcatctttaccatcgtgcaggacgttccgattaaaacgctggggaccagcacgctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagc

SEQ ID NO: 388 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGLVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGGYDASGRSPFYGYGRMNARKAVELAMPEWESPVIIFTIVQDVPIKTLGTSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 389 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtctggttggtgcgagcggtgttgcgccgggtgcgcgtctgatgccgatccgtctggcgagcggtctgggcagccaggcggaagcggatgcgtttgtttgggcggcgcaaaagggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcacgcggcaactacgatgcgagcggtcgtagcccgttctacggttatggccgtatgaacgcgcgtaaggcggtggaactggcgatgccggagtgggaaagcccggttagcatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagc

SEQ ID NO: 390 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGLVGASGVAPGARLMPIRLASGLGSQAEADAFVWAAQKGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQARGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 391 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacgcgaaccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggcggcggttacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcaaggtacctgggcgctggaagttgcggacaaagtgcagcgtgacattggcaagatgcgtagctttaccctggaactgggctttgagcaaccgagc

SEQ ID NO: 392 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNANQGDAAGNYTNSFGGTSSACPGAAGVAALIIARNPNLRWDQVREIIKQSCDRIDQAGGGYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 393 - DNA, 1998 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacgcacgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggcggcggttacgatgcgagcggtcgtagcccgttctacggttatggccgtatgaacgcgcgtaaggcggtggaactggcgatgccggagtgggaaagcccggttagtatctttaccatcgtgcaggacgttccgattaaacgcctggggaccagcgaactgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagc

SEQ ID NO: 394 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNARQGDAAGNYTNSFGGTSSACPGAAGVAALIIARNPNLRWDQVREIIKQSCDRIDQAGGGYDASGRSPFYGYGRMNARKAVELAMPEWESPVSIFTIVQDVPIKRLGTSELTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 395 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 396 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 397 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccgtggtaacgctcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagcccagcgtgacattggcaagatgcgtagctttaccctggaactgggctttgagcaaccgagcggccaaactggccaccatcaccatcaccattag

SEQ ID NO: 398 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNARQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKAQRDIGKMRSFTLELGFEQPSGQTGHHHHHH

SEQ ID NO: 399 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 400 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 401 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 402 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 403 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccctggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctgggcgctggaagttgcggacaaagcccagcgtgacattggcaagatgcgtagctttaccctggaactgggctttgagcaaccgagcggccaaactggccaccatcaccatcaccattag

SEQ ID NO: 404 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNLRQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPSGQTGHHHHHH

SEQ ID NO: 405 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccctggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 406 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 407 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggcgaaagtgcagcgtgacattggcaagatgcgtagctttaccctggaactgggctttgagcaaccgagcggccaaactggccaccatcaccatcaccattag

SEQ ID NO: 408 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVAAKVQRDIGKMRSFTLELGFEQPSGQTGHHHHHH

SEQ ID NO: 409 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 410 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 411 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccgcgttgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 412 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPRWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 413 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggtgtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 414 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPVWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 415 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgtgatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 416 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVVIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 417 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctggtggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 418 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLVAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 419 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggacaaagtgcagcgtgacattggcaagatgcgtagctttaccctggaactgggctttgagcaaccgagcggccaaactggccaccatcaccatcaccattag

SEQ ID NO: 420 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVADKVQRDIGKMRSFTLELGFEQPSGQTGHHHHHH

SEQ ID NO: 421 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttagggacaaagtgcagcgtgacattggcaagatgcgtagctttaccctggaactgggctttgagcaaccgagcggccaaactggccaccatcaccatcaccataag

SEQ ID NO: 422 - protein, 677 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVRDKVQRDIGKMRSFTLELGFEQPSGQTGHHHHHHK

SEQ ID NO: 423 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcgccgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 424 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAPTDNIKKTYDVVNAPGLAACKGKSPQGTWALEVADKVQRDIGKMRSFTLELGFEQPSGQTGHHHHHH

SEQ ID NO: 425 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcggttaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 426 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAVNQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 427 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgcgggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 428 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLRAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 429 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcgagtaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 430 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGASTDNIKKTYDVVNAPGLAACKGKSPQGTWALEVADKVQRDIGKMRSFTLELGFEQPSGQTGHHHHHH

SEQ ID NO: 431 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcgttgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 432 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGALTDNIKKTYDVVNAPGLAACKGKSPQGTWALEVADKVQRDIGKMRSFTLELGFEQPSGQTGHHHHHH

SEQ ID NO: 433 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaagccgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 434 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPSGQTGHHHHHH

SEQ ID NO: 435 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgaggacaaagtgcagcgtgacattggcaagatgcgtagctttaccctggaactgggctttgagcaaccgagcggccaaactggccaccatcaccatcaccattag

SEQ ID NO: 436 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVEDKVQRDIGKMRSFTLELGFEQPSGQTGHHHHHH

SEQ ID NO: 437 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggagctggaagttgcggacaaagtgcagcgtgacattggcaagatgcgtagctttaccctggaactgggctttgagcaaccgagcggccaaactggccaccatcaccatcaccattag

SEQ ID NO: 438 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWELEVADKVQRDIGKMRSFTLELGFEQPSGQTGHHHHHH

SEQ ID NO: 439 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccatagg

SEQ ID NO: 440 - protein, 677 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHHR

SEQ ID NO: 441 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 442 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 443 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccgtggtaacgctaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 444 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 445 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgcggacaaagtccagcgtgacattggcaagatgcgtagctttaccctggaactgggctttgagcaaccgagcggccaaactggccaccatcaccatcaccatagg

SEQ ID NO: 446 - protein, 677 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHHR

SEQ ID NO: 447 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 448 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 449 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagcccagcgtgacattggcaagatgcgtagctttaccctggaactgggctttgagcaaccgagcggccaaactggccaccatcaccatcaccataag

SEQ ID NO: 450 - protein, 677 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKAQRDIGKMRSFTLELGFEQPSGQTGHHHHHHK

SEQ ID NO: 451 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccgcgctgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagcggccaaactggccaccatcaccatcaccattag

SEQ ID NO: 452 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVAAKVQRDIGKMRSFTLELGFEQPSGQTGHHHHHH

SEQ ID NO: 453 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 454 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 455 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtatctttaccatcgtgcaggacgttccgattaaagatctggaaaccagcaccctgtcgctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagcggccaaactggccaccatcaccatcaccattag

SEQ ID NO: 456 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLSLAIANTDLIKSIKVSVDIEHSYIGDLVVTLKAPVEMGVDPMLLHNREGAATDNIKKTYDVVNAPGLAACKGKSPQGTWALEVADKVQRDTGKMRSFTLELGFEQPSGQTGHHHHHH

SEQ ID NO: 457 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtacggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 458 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 459 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccgcgctgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttcgcgccaaagtgcagcgtgacattggcaagatgcgtagctttaccctggaactgggctttgagcaaccgagcggccaaactggccaccatcaccatcaccattag

SEQ ID NO: 460 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPRWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVRAKVQRDIGKMRSFTLELGFEQPSGQTGHHHHHH

SEQ ID NO: 461 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccgcgctgggaaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagcggccaaactggccaccatcaccatcaccattag

SEQ ID NO: 462 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPRWESPVSIFTIVQDVPIKDLETSTLTLAIANTDLIKSIKVGVDIEHSYIGDLVVTLKAPVEMGVDPMLLHNREGAATDNIKKTYDVVNAPGLAACKGKSPQGTWKLEVAAKVQRDIGKMRSFTLELGFEQPSGQTGHHHHHH

SEQ ID NO: 463 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggtatgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcactggaagttcgcgccaaagtgcagcgtgacattggcaagatgcgtagctttaccctggaactgggctttgagcaaccgagcggccaaactggccaccatcaccatcaccattag

SEQ ID NO: 464 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPVWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVRAKVQRDIGKMRSFTLELGFEQPSGQTGHHHHHH

SEQ ID NO: 465 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 466 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 467 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgagcaggacgttccgattaaagatctggaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 468 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVRSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIEQDVPIKDLETSTLTLAIANTDLIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 469 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcaccctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 470 - protein, 676 aa, Artificial Sequence
  Variant of serine endopeptidase from Microcoleus sp. PCC 7113
MVTVRYGGRNGEPYELTISDEHIVVRTENRSTLTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 471 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacattgaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 472 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDIDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGCVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 473 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 474 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 475 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagttacattggcgatctggtggttaccctgaagccaccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 476 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPSGQTGHHHHHH

SEQ ID NO: 477 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 478 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 479 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtggcgcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagcggccaaactggccaccatcaccatcaccattag

SEQ ID NO: 480 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGGATDNIKKTYDVVNAPGLAACKGKSPQGTWALEVADKVQRDIGKMRSFTLELGFEQPSGQTGHHHHHH

SEQ ID NO: 481 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacctgatcaagagcattaaagtgagcgttgacatcgaacacagttacattggcgatctggtggttaccctgaaggcgccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 482 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLQTSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 483 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 484 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDLIKSIKVSVDIEHTYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 485 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacctgatcaagagcattaaagtgagcgttgacatcgaacacagttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 486 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVRSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLQTSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 487 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacattgaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggaccaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacccgatcaagagcattaaagtgagcgttgacatcgaacacagttacattggcgatctggtggttaccctgaagccaccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagcggccaaactggccaccatcaccatcaccattag

SEQ ID NO: 488 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDIDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALILARNPNLRWDQVREIIKQSCDRIDQAGGNYDASGRSPFYGYGRMNARKAVELAMPEWESPVSIFTIVQDVPIKDLQTSTLTLAIANTDPIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPSGQTGHHHHHH

SEQ ID NO: 489 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 490 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 491 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacacttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagcggccaaactggccaccatcaccatcaccattag

SEQ ID NO: 492 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVRSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDPIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 493 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaagccaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagcggccaaactggccaccatcaccatcaccattag

SEQ ID NO: 494 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPSGQTGHHHHHH

SEQ ID NO: 495 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggaccttgaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 496 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 497 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtggcgcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 498 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLQTSTLTLAIANTDLIKSIKVSVDIEHTYIGDLVVTLKAPVEMGVDPMLLHNREGGATDNIKKTYDVVNAPGLAACKGKSPQGTWTLEVADKVQRDIGKMRSFTLELGFEQPSGQTGHHHHHH

SEQ ID NO: 499 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagcggccaaactggccaccatcaccatcaccattag

SEQ ID NO: 500 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVRSAYSDFGNAVWCAFPSNDGRPSKTPGIWTTDRMGRLGYNRGNLRQGDAAGNYTNSFGGTSSACPGAAGVAALILARNPNLRWDEVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 501 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggctggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgattctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagcggccaaactggccaccatcaccatcaccattag

SEQ ID NO: 502 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWALEVADKVQRDTGKMRSFTLELGFEQPSGQTGHHHHHH

SEQ ID NO: 503 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccatggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggaatgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagcggccaaactggccaccatcaccatcaccattag

SEQ ID NO: 504 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINHGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVAAKVQRDIGKMRSFTLELGFEQPSGQTGHHHHHH

SEQ ID NO: 505 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtacggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggagagcccggttagtatctttaccatcgtgcaggacgttccgattaaagatctggaaaccagcaccctgacgctggcgatcgcgaacaccgacctgatcaagagcattaaagtgagcgttgacatcgaacacagctacattggcgatctggtggttaccctgaaggcgccggtggagatgggcgttgatccgattctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagcggccaaactggccaccatcaccatcaccattag

SEQ ID NO: 506 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWALEVADKVQRDTGKMRSFTLELGFEQPSGQTGHHHHHH

SEQ ID NO: 507 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 508 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 509 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagttacattggcgatctggtggttaccctgaagccaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagcggccaaactggccaccatcaccatcaccattag

SEQ ID NO: 510 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKPPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 511 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagcggccaaactggccaccatcaccatcaccattag

SEQ ID NO: 512 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVAAKVQRDIGKMRSFTLELGFEQPSGQTGHHHHHH

SEQ ID NO: 513 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggaatgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcactggaagttgcggccaaagtgcagcgtgacattggcaagatgcgtagctttaccctggaactgggctttgagcaaccgagcggccaaactggccaccatcaccatcaccattag

SEQ ID NO: 514 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVAAKVQRDIGKMRSFTLELGFEQPSGQTGHHHHHH

SEQ ID NO: 515 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccgcgctgggaaagcccggttagtatctttaccatcgagcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcactggaagttgcggccaaagtgcagcgtgacattggcaagatgcgtagctttaccctggaactgggctttgagcaaccgagcggccaaactggccaccatcaccatcaccattag

SEQ ID NO: 516 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWESPVSIFTIEQDVPIKDLETSTLTLAIANTDLIKSIKVGVDIEHSYIGDLVVTLKAPVEMGVDPMLLHNREGAATDNIKKTYDVVNAPGLAACKGKSPQGTWALEVAAKVQRDIGKMRSFTLELGFEQPSGQTGHHHHHH

SEQ ID NO: 517 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtacggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgcctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcgtagcccgttctacggttatggccgtatgaacgcgcgtaaggcggtggaactggcgatgccggagtggccaagcccggttagtatctttaccatcgtgcaggacgttccgattaaagatctggaaaccagcaccctgtcgctggcgatcgcgaacaccgacctgatcaagagcattaaagtgagcgttgacatcgaacacagctacattggcgatctggtggttaccctgaaggcgccggtggagatgggcgttgatccgattctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 518 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGRSPFYGYGRMNARKAVELAMPEWPSPVSIFTIVQDVPIKDLETSTLSLAIANTDLIKSIKVSVDIEHSYIGDLVVTLKAPVEMGVDPILLHNREGAATDNIKKTYDVVNAPGLAACKGKSPQGTWALEVADKVQRDIGKMRSFTLELGFEQPSGQTGHHHHHH

SEQ ID NO: 519 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgttcggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgacgctggcgatcgcgaacaccgacctgatcaagagcattaaagtgagcgttgacatcgaacacagctacattggcgatctggtggttaccctgaaggcgccggtggagacgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccggacggccaaactggccaccatcaccatcaccattag

SEQ ID NO: 520 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGHSPFYGYGRMNARKAVELAMPEWESPVSIFTIVQDVPIKDLETSTLTLAIANTDLIKSIKVSVDIEHSYIGDLVVTLKAPVETGVDPMLLHNREGAATDNIKKTYDVVNAPGLAACKGKSPQGTWALEVADKVQRDIGKMRSFTLELGFEQPDGQTGHHHHHH

SEQ ID NO: 521 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgttcggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcatagcccgttttacggttatggccgtatgaacgcgcgtaaggcggtggaactggcgatgccggagtggccaagcccggttagtatctttaccatcgtgcaggacgttccgattaaagatctggaaaccagcaccctgtcgctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 522 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGHSPFYGYGRMNARKAVELAMPEWPSPVSIFTIVQDVPIKDLETSTLSLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 523 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 524 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 525 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 526 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 527 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgagtctggcgatcgcgaacaccgacctgatcaagagcattaaagtgagcgttgacatcgaacacacttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttcgcgataaagtgcagcgtgacattggcaagatgcgtagctttaccctggaactgggctttgagcaaccgagcggccaaactggccaccatcaccatcaccattag

SEQ ID NO: 528 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLSLAIANTDLIKSIKVSVDIEHTYIGDLVVTLKAPVEMGVDPMLLHNREGAATDNIKKTYDVVNAPGLAACKGKSPQGTWTLEVRDKVQRDIGKMRSFTLELGFEQPSGQTGHHHHHH

SEQ ID NO: 529 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcagttgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 530 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 531 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 532 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVGVDIEHSYIGDLVVTLKAPVEMGVDPILLHNREGAATDNIKKTYDVVNAPGLAACKGKSPQGTWALEVADKVQRDIGKMRSFTLELGFEQPSGQTGHHHHHH

SEQ ID NO: 533 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggaatggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccggatggccaaactggccaccatcaccatcaccattag

SEQ ID NO: 534 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVGVDIEHSYIGDLVVTLKAPVEMGVDPMLLHNREGAATDNIKKTYDVVNAPGLAACKGKSPQGTWALEVADKVQRDTGKMRSFTLELGFEQPDGQTGHHHHHH

SEQ ID NO: 535 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagcggccaaactggccaccatcaccatcaccattag

SEQ ID NO: 536 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINKGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWALEVADKVQRDTGKMRSFTLELGFEQPSGQTGHHHHHH

SEQ ID NO: 537 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 538 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 539 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggaatggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagcggccaaactggccaccatcaccatcaccattag

SEQ ID NO: 540 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALILARNPNLRWDQVREIIKQSCDRIDQAGGNYDASGHSPFYGYGRMNARKAVELAMPEWPSPVSIFTIVQDVPIKDLETSTLTLAIANTDLIKSIKVGVDIEHSYIGDLVVTLKAPVEMGVDPILLHNREGAATDNIKKTYDVVNAPGLAACKGKSPQGTWALEVADKVQRDTGKMRSFTLELGFEQPSGQTGHHHHHH

SEQ ID NO: 541 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 542 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 543 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 544 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVGVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 545 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 546 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALILARNPNLRWDQVREIIKQSCDRIDQAGGNYDASGHSPFYGYGRMNARKAVELAMPRWPSPVSIFTIVQDVPIKDLETSTLTLAIANTDPIKSIKVSVDIEHSYIGDLVVTLKAPVEMGVDPILLHNREGAATDNIKKTYDVVNAPGLAACKGKSPQGTWALEVADKVQRDIGKMRSFTLELGFEQPSGQTGHHHHHH

SEQ ID NO: 547 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 548 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRFASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 549 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggagaccagcaccctgactctggcgatcgcgaacaccgacctgatcaagagcattaaagtgagcgttgacatcgaacacagttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 550 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 551 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctgcagaccagcaccctgagtctggcgatcgcgaacaccgacctgatcaagagcattaaagtgagcgttgacatcgaacacagctacattggcgatctggtggttaccctgaaggcgccggtggagacgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 552 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLQTSTLSLAIANTDLIKSIKVSVDIEHSYIGDLVVTLKAPVETGVDPMLLHNREGAATDNIKKTYDVVNAPGLAACKGKSPQGTWALEVADKVQRDIGKMRSFTLELGFEQPSGQTGHHHHHH

SEQ ID NO: 553 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacacttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttcgcgataaagtgcagcgtgacattggcaagatgcgtagctttaccctggaactgggctttgagcaaccgagcggccaaactggccaccatcaccatcaccattag

SEQ ID NO: 554 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHTYIGDLVVTLKAPVEMGVDPMLLHNREGAATDNIKKTYDVVNAPGLAACKGKSPQGTWALEVRDKVQRDIGKMRSFTLELGFEQPSGQTGHHHHHH

SEQ ID NO: 555 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtggccaagcccggttagtatctttaccatcgtgcaggaggttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 556 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQEVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 557 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctgcagaccagcaccctgactctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgccgataaagtgcagcgtgacattggcaagatgcgtagctttaccctggaactgggctttgagcaaccgagcggccaaactggccaccatcaccatcaccattag

SEQ ID NO: 558 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLQTSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 559 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgactctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 560 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 561 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 562 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 563 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggagaccagcaccctgagtctggcgatcgcgaacaccgacctgatcaagagcattaaagtgagcgttgacatcgaacacacttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 564 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLSLAIANTDLIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 565 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcggtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagtggccaaactggccaccatcaccatcaccattag

SEQ ID NO: 566 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSGVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDPIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 567 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 568 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 569 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtagtgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagtggccaaactggccaccatcaccatcaccattag

SEQ ID NO: 570 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINKGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDTGKMRSFTLELGFEQPSGQTGHHHHHH

SEQ ID NO: 571 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtagtgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccggatggccaaactggccaccatcaccatcaccattag

SEQ ID NO: 572 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVGVDIEHSYIGDLVVTLKAPVEMGVDPILLHNREGAATDNIKKTYDVVNAPGLAACKGKSPQGTWALEVADKVQRDIGKMRSFTLELGFEQPDGQTGHHHHHH

SEQ ID NO: 573 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtggaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagcggccaaactggccaccatcaccatcaccattag

SEQ ID NO: 574 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWWNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 575 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaagttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 576 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWYNPWDPRHNQKVPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 577 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 578 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 579 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggccagcggtctgggcagccaggaggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 580 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 581 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggccagcggtctgggcagccaggaggaagcggatgcgtttgtttgggcggcgcaaaacggtgcggatgttattagctgcagctggggtccgccggacggtgtttggtggaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 582 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWWNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 583 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgccgataaagtgcagcgtgacattggcaagatgcgtagctttaccctggaactgggctttgagcaaccgagcggccaaactggccaccatcaccatcaccattag

SEQ ID NO: 584 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 585 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttggtatgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 586 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWYEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 587 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatcgctaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 588 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIATIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 589 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatcgttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccattaccatcaccattag

SEQ ID NO: 590 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIVTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHYHHH

SEQ ID NO: 591 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactggattttgagcaaccgagcggccaaactggccaccatcaccatcaccattag

SEQ ID NO: 592 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELDFEQPSGQTGHHHHHH

SEQ ID NO: 593 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatgtttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 594 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSMFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 595 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgcgtatagcgatttcggcaacgcggtttggtgcgcgtttccgagcaacgacggccgtcctagcaaaaccccgggtatttggaccaccgatcgtatgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 596 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRVGYNRGNLRQGDAAGNYTNSFGGTSSACPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 597 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 598 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 599 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcatggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtcacattggcaagatgcgtagctttaccctggaactgggctttgagcaaccgagcggccaaactggccaccatcaccatcaccattag

SEQ ID NO: 600 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSMVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRHIGKMRSFTLELGFEQPSGQTGHHHHHH

SEQ ID NO: 601 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagctgtcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 602 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSCQGTWTLEVADKVQRDIGKMRSFTLELGFEQPSGQTGHHHHHH

SEQ ID NO: 603 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 604 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 605 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcacagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggacgctggaagttgccgataaagtgcagcgtgacattggcaagatgcgtagctttaccctggaactgggctttgagcaaccgagcggccaaactggccaccatcaccatcaccattag

SEQ ID NO: 606 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRVGYNRGNLRQGDAAGNYTNSFGGTSSACPGAAGVAALIIARNPNLRWDEVREIIKQSCDRIDQQGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPSGQTGHHHHHH

SEQ ID NO: 607 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgttcgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagccggtggcaactacgatgcgagtggtcgcagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctgggcgctggaagttgccgataaagtgcagcgtgacattggcaagatgcgtagctttaccctggaactgggctttgagcaaccgagcggccaaactggccaccatcaccatcaccattag

SEQ ID NO: 608 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRSGRVGYNRGNLRQGDAAGNYTNSFGGTSSACPGAAGVAALIIARNPNLRWDEVREIIKQSCDRIDQAGGNYDASGRSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKVQRDIGKMRSFTLELGFEQPSGQTGHHHHHH

SEQ ID NO: 609 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagccggtggcaactacgatgcgagtggtcacagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggacgctggaagttgccgataaagtgcagcgtgacattggcaagatgcgtagctttaccctggaactgggctttgagcaaccgagcggccaaactggccaccatcaccatcaccattag

SEQ ID NO: 610 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPSGQTGHHHHHH

SEQ ID NO: 611 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 612 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 613 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 614 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 615 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaacagggtggcaactacgatgcgagtggtcgcagcccgttctacggttatggccgtatgaacgcgcgtaaggcggtggaactggcgatgccggagtggcctagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgccgataaagcgcagcgtgacattggcaagatgcgtagctttaccctggaactgggctttgagcaaccgagcggccaaactggccaccatcaccatcaccattag

SEQ ID NO: 616 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQQGGNYDASGRSPFYGYGRMNARKAVELAMPEWPSPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKAQRDIGKMRSFTLELGFEQPSGQTGHHHHHH

SEQ ID NO: 617 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 618 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPSGQTGHHHHHH

SEQ ID NO: 619 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaggctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 620 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSRLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 621 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgaaccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 622 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLNQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDEVNAPGLAACKGKSPQGTWTLEVADKVQRDIGKMRSFTLELGFEQPSGQTGHHHHHH

SEQ ID NO: 623 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcacagcccgttctacggttatggccgtatgaacgcgcgtaaggcggtggaactggcgatgccggagtggcctagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgccgataaagtgcagcgtgacattggcaagatgcgtagctttaccctggaactgggctttgagcaaccgagcggccaaactggccaccatcaccatcaccattag

SEQ ID NO: 624 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQQGGNYDASGHSPFYGYGRMNARKAVELAMPEWPSPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPSGQTGHHHHHH

SEQ ID NO: 625 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaatgatccgcgtcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagccggtggcaactacgatgcgagtggtcgcagcccgttctacggttatggccgtatgaacgcgcgtaaggcggtggaactggcgatgccggagtggcctagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggacgctggaagttgccgataaagtgcagcgtgacattggcaagatgcgtagctttaccctggaactgggctttgagcaaccgagcggccaaactggccaccatcaccatcaccattag

SEQ ID NO: 626 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPNDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 627 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtagttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 628 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPSGQTGHHHHHH

SEQ ID NO: 629 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtggaacccgtgggatccgcgccacaaccagaaagttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 630 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWWNPWDPRHNQKVPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPSGQTGHHHHHH

SEQ ID NO: 631 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtgtgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 632 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRVGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 633 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaataaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgaatgatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcacagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 634 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPNDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQQGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 635 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcatggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggcggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 636 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEIMERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 637 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 638 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 639 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcacccataccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 640 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTHTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 641 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcacctcgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 642 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTSTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 643 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacggtgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 644 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANGDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 645 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggcctagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 646 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 647 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 648 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 649 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtcagcggtctgggcagccaggcggaagcggatgcgtttgtttgggcggcgcaaaacggtgcggatgttattagctgcagctggggtccgccggacggtgtttggtggaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 650 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWWNPWDPRHNQKFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPSGQTGHHHHHH

SEQ ID NO: 651 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggccagcggtctgggcagccaggaggaagcggatgcgtttgtttgggcggcgcaaaacggtgcggatgttattagctgcagctggggtccgccggacggtgtttggtggaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 652 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWWNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPSGQTGHHHHHH

SEQ ID NO: 653 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtggaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 654 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWWNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWTLEVADKVQRDIGKMRSFTLELGFEQPSGQTGHHHHHH

SEQ ID NO: 655 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggcggaagcggatgcgtttgtttgggcggcgcaaaacggtgcggatgttattagctgcagctggggtccgccggacggtgtttggtacaacccgtgggatccgcgccacaaccaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 656 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQAEADAFVWAAQNGADVISCSWGPPDGVWYNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 657 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgttcgggccgtctgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcgcagcccgttctacggttatggccgtatgaacgcgcgtaaggcggtggaactggcgatgccggagtgggaaagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 658 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRSGRLGYNRGNLRQGDAAGNYTNSFGGTSSACPGAAGVAALIIARNPNLRWDEVREIIKQSCDRIDQQGGNYDASGRSPFYGYGRMNARKAVELAMPEWESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 659 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgctgcacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccgtggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaacagggtggcaactacgatgcgagtggtcgcagcccgttctacggttatggccgtatgaacgcgcgtaaggcggtggaactggcgatgccggagtgggaaagcccggttagtatctttaccgccgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 660 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPLHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQQGGNYDASGRSPFYGYGRMNARKAVELAMPEWESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 661 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagttatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 662 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 663 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtagttttacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 664 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSSFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 665 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagttatcgcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 666 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIFTIVQDVPIKDLETSTLTLAIANTDLIKSIKVSVDIEHSYRGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 667 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 668 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 669 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcagggggcaactacgatgcgagtggtcatagcccgttctacggttatggccgtatgaacgcgcgtaaggcgggggaactggcgatgccggagtggccaagcccggttagtatttttaccatcgtgcaggacgttccgattaaagatctggaaaccagcaccctgaccctggcgatcgcgaacaccgacctgatcaagatcattaaagtgagcgttgacatcgaacactgcgtcgtcggcgatctggtggttgccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 670 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAGELAMPEWPSPVSIFTIVQDVPIKDLETSTLTLAIANTDLIKIIKVSVDIEHCVVGDLVVALKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 671 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggttggtggcaaccgagcggccaaactggccaccatcaccatcaccattag

SEQ ID NO: 672 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGWWQPSGQTGHHHHHH

SEQ ID NO: 673 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcatgttctacggttatggccgtatgaacgcgcgtaaggcggtggaactggcgatgccggagtggccaagcgaagttagtatctttaccatcgtgcaggacgttccgattaaagatctggagaccagcaccctgaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 674 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSMFYGYGRMNARKAVELAMPEWPSEVSIFTIVQDVPIKDLETSTLTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 675 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 676 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWESPVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 677 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcgaagttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 678 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSEVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 679 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgccccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 680 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 681 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttattattggcacgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 682 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVIIGTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 683 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagctacatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 684 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 685 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacgggggcaagatgcgtagctttaccctggaactgggctttgagcaaccgagcggccaaactggccaccatcaccatcaccattag

SEQ ID NO: 686 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDGGKMRSFTLELGFEQPSGQTGHHHHHH

SEQ ID NO: 687 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgtggcgtgacattggcaagatgcgtagctttaccctggaactgggctttgagcaaccgagcggccaaactggccaccatcaccatcaccattag

SEQ ID NO: 688 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVWRDIGKMRSFTLELGFEQPSGQTGHHHHHH

SEQ ID NO: 689 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagttatcgcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 690 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYRGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 691 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcatgttctatggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 692 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSMFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 693 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagtgtgatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 694 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSVIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 695 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtattggcacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 696 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIGTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 697 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagaggccgagcggccaaactggccaccatcaccatcaccattag

SEQ ID NO: 698 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 699 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagccctgttagtatctttaccatcgtgcaggacgttccgattaaagatctggaaaccagcaccagcaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 700 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTSTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 701 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagccctgttagtatctttaccatcgtgcaggacgttccgattaaagatctggagaccagcaccagcaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 702 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTSTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 703 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgttgcgtgacattggcaagatgcgtagctttaccctggaactgggctttgagcaaccgagcggccaaactggccaccatcaccatcaccattag

SEQ ID NO: 704 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVLRDIGKMRSFTLELGFEQPSGQTGHHHHHH

SEQ ID NO: 705 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtagttttacgatcgtgcaggacgttccgattaaagatctggaaaccagcaccctgaccctggcgatcgcgaacaccgacctgatcaagagcattaaagtgagcgttgacatcgaacacagtcgtcgcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 706 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSSFTIVQDVPIKDLETSTLTLAIANTDLIKSIKVSVDIEHSRRGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 707 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgggccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 708 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDGPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 709 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcagagggttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 710 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQRVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 711 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtgggagagcccggttagtatttttacgatcgtgcaggacgttccgattaaagatctggaaaccagcaccctgaccctggcgatcgcgaacaccgacctgatcaagagcattaaagtgagcgttgacatcgaacacagtgtgatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 712 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWESPVSIFTIVQDVPIKDLETSTLTLAIANTDLIKSIKVSVDIEHSVIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 713 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatttttctgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 714 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDSSGHSPFYGYGRMNARKAVELAMPEWPSPVSIFLIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 715 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtattggcacgatcgtgcaggacgttccgattaaagatctggaaaccagcaccctgaccctggcgatcgcgaacaccgacctgatcaagagcattaaagtgagcgttgacatcgaacacagtcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 716 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWESPVSIGTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 717 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtagttttctgatcgtgcaggacgttccgattaaagatctggaaaccagcaccctgaccctggcgatcgcgaacaccgacctgatcaagagcattaaagtgagcgttgacatcgaacaccgttatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 718 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSSFLIVQDVPIKDLETSTLTLAIANTDLIKSIKVSVDIEHRYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 719 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtagttttctgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 720 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWESPVSSFLIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 721 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccgggtagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 722 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPGSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 723 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcgaagttagtatctttaccatcgtgcaggacgttccgattaaagatctggaaaccagcaccctgaccctggcgatcgcgaacaccgaccgtatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggtttcgaacaaccgagcggccaaactggccaccatcaccatcaccattag

SEQ ID NO: 724 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSEVSIFTIVQDVPIKDLETSTLTLAIANTDRIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 725 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccaggtctttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtattggcctgatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 726 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIGLIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 727 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggatcacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcatgttctacggttatggccgtatgaacgcgcgtaaggcggtggaactggcgatgccggagtggccaagcgaagttagtatctttaccatcgtgcaggacgttccgattaaagatctggggaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 728 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSMFYGYGRMNARKAVELAMPEWPSEVSIFTIVQDVPIKDLGTSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 729 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 730 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDDSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 731 - DNA, 2031 bp, Artificial Sequence
  Variant of serine endopeptidase from Microcoleus sp. PCC 7113
atggtgactgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacacccgcctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 732 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDDSGHSPFYGYGRMNARKAVELAMPEWPSPVSIFTIVQDVPIKDLETSTLTLAIANTRLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 733 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcctggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 734 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDDSGHSPFYGYGRMNARKAVELAMPEWPSLVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 735 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 736 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 737 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcacgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtgagggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggcttcgaacaaccgagcggccaaactggccaccatcaccatcaccattag

SEQ ID NO: 738 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLREGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 739 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgacagtggtcatagcccgttctacggttatggccgtatgaacgcgcgtaaggcggtggaactggcgatgccggagtggccaagcccggttagtatttttaccatcgtgcaggacgttccgattaaagatctggaaaccagcaccctgaccctggcgatcgcgaacaccgaccgcatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 740 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDDSGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 741 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtatttttaccatcgtgcaggacgttccgattaaagatctggaaaccagcaccctgaccctggcgatcgcgaacacccgcctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 742 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTRLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 743 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcctggttagtatttttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 744 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSLVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 745 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtctggccaccatcgtgcaggacgttccgattaaagatctggaaaccagcaccctgaccctggcgatcgcgaacaccgaccgcatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 746 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSLATIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 747 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgttgcgcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtatttttaccatcgtgcaggacgttccgattaaagatctggaaaccagcaccctgaccctggcgatcgcgaacacccgccgcatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 748 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 749 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgttgcgcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcccggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 750 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 751 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcctggttagtattgccaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 752 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSLVSIATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 753 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggattttgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgccagtggtcatagcccgttctacggttatggccgtatgaacgcgcgtaaggcggtggaactggcgatgccggagtggccaagcctggttagtattgacaccatcgtgcaggacgttccgattaaagatctggaaaccagcaccctgaccctggcgatcgcgaacacccgcctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 754 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSLVSIDTIVQDVPIKDLETSTLTLAIANTRLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 755 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 756 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 757 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 758 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 759 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcgccctgatggagactcgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 760 - protein, 676 aa, Artificial Sequence
  Variant of serine endopeptidase from Microcoleus sp. PCC 7113
MVTVRYGGRNGEPYELTISDEHIVVRTENRSALMETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 761 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcatcctgaccgaaacccgtccgtacgaggtgacctcggttagcccggaggcgcgtagcatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 762 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARSILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 763 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcatcctgaccgaaacccgtccgtacgaggtgacctcggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 764 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 765 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctacacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagcggccaaactggccaccatcaccatcaccattag

SEQ ID NO: 766 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 767 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccggtcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccattgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagcggccaaactggccaccatcaccatcaccattag

SEQ ID NO: 768 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPVPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 769 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagcatttttaccattgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagcggccaaactggccaccatcaccatcaccattag

SEQ ID NO: 770 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 771 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 772 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 773 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 774 - protein, 676 aa, Artificial Sequence
  Variant of serine endopeptidase from Microcoleus sp. PCC 7113
MVTVRYGGKNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 775 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 776 - protein, 676 aa, Artificial Sequence
  Variant of serine endopeptidase from Microcoleus sp. PCC 7113
MVTVRYGGKNGEPYELTISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 777 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaatcgtagcgccctgacggagactcgtccgtacgaggtgaccagcgttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctggggtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 778 - protein, 676 aa, Artificial Sequence
  Variant of serine endopeptidase from Microcoleus sp. PCC 7113
MVTVRYGGKNGEPYELTISDEHIVVRTENRSALTETRPYEVTSVSPEARNILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 779 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagagtcgtagcattctgacggggactcgtccgtacgaggtgaccccggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtgtctttaccatcgtgcaggacgttccgattaaagatatggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 780 - protein, 676 aa, Artificial Sequence
  Variant of serine endopeptidase from Microcoleus sp. PCC 7113
MVTVRYGGKNGEPYELTISDEHIVVRTESRSILTGTRPYEVTPVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSVFTIVQDVPIKDMETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 781 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgacctcggttagcccggaggcgcgtagcatcctggaccagttcgagctggaaacccgttttcgtgaggcgggtgtggagattctgcgtgcgaaggacccgcgtgaaaacagcgcgctccgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 782 - protein, 676 aa, Artificial Sequence
  Variant of serine endopeptidase from Microcoleus sp. PCC 7113
MVTVRYGGKNGEPYELTISDEHIVVRTENRSILTETRPYEVTSVSPEARSILDQFELETRFREAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 783 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 784 - protein, 676 aa, Artificial Sequence
  Variant of serine endopeptidase from Microcoleus sp. PCC 7113
MVTVRYGGKNGEPYELTISDEHIVVRTENRSILTETRPYEVTPVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 785 - DNA, 2031 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 786 - protein, 676 aa, Artificial Sequence
  Variant of serine endopeptidase from Microcoleus sp. PCC 7113
MVTVRYGGKNGEPYELAISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 787 - DNA, 2031 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaaccgtagcatcctgaccgaaacccgtccgtacgaggtgaccagcgttagcccggaggcgcgtagcatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 788 - protein, 676 aa, Artificial Sequence
  Variant of serine endopeptidase from Microcoleus sp. PCC 7113
MVTVRYGGKNGEPYELAISDEHIVVRTENRSILTETRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 789 - DNA, 2031 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaatcgtagcattctgatggggactcgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatatggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 790 - protein, 676 aa, Artificial Sequence
  Variant of serine endopeptidase from Microcoleus sp. PCC 7113
MVTVRYGGKNGEPYELAISDEHIVVRTENRSILMGTRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDMETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 791 - DNA, 2031 bp, Artificial Sequence
  Variant of serine endopeptidase from Microcoleus sp. PCC 7113
atggtgaccgtgcgttatggcggccagaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatatttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 792 - protein, 676 aa, Artificial Sequence
  Variant of serine endopeptidase from Microcoleus sp. PCC 7113
MVTVRYGGQNGEPYELAISDEHIVVRTENRSILTETRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 793 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcatcctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 794 - protein, 676 aa, Artificial Sequence
  Variant of serine endopeptidase from Microcoleus sp. PCC 7113
MVTVRYGGRNGEPYELTISDEHIVVRTENRSILTETRPYEVTPVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 795 - DNA, 2031 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagaatcgtagcgccctgatggggactcgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 796 - protein, 676 aa, Artificial Sequence
  Variant of serine endopeptidase from Microcoleus sp. PCC 7113
MVTVRYGGRNGEPYELAISDEHIVVRTENRSALMGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 797 - DNA, 2031 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 798 - protein, 676 aa, Artificial Sequence
  Variant of serine endopeptidase from Microcoleus sp. PCC 7113
MVTVRYGGRNGEPYELAISDEHIVVRTENRSILTETRPYEVTSVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 799 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagcctggcgaccattgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagcggccaaactggccaccatcaccatcaccattag

SEQ ID NO: 800 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSLATIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 801 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcctggttcgcatttttaccattgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcagccgagcggccaaactggccaccatcaccatcaccattag

SEQ ID NO: 802 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSLVRIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPSGQTGHHHHHH

SEQ ID NO: 803 - DNA, 2031 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagagtcgtagcattctgatgggggatcgtccgtacgaggtgaccagcgttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 804 - protein, 676 aa, Artificial Sequence
  Variant of serine endopeptidase from Microcoleus sp. PCC 7113
MVTVRYGGRNGEPYELAISDEHIVVRTESRSILMGDRPYEVTSVSPEARNILDQFELETRFRAAGVEILRAKDPREDSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 805 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcattctgaccgaaacccgtccgtacgaggtgacctcggttagcccggaggcgcgtagcatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 806 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARSILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 807 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagcggccaaactggccaccatcaccatcaccattag

SEQ ID NO: 808 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 809 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcaaccgagcggccaaactggccaccatcaccatcaccattag

SEQ ID NO: 810 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPSGQTGHHHHHH

SEQ ID NO: 811 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 812 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 813 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgttgcgcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcaaccgagcggccaaactggccaccatcaccatcaccattag

SEQ ID NO: 814 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPSGQTGHHHHHH

SEQ ID NO: 815 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcggcgaccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 816 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIAATDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 817 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaacccgaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaaccccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 818 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNPKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPTPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 819 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccattgtgcaggacgttccgattaaagatctggaaaccagcaccctgaccctggcgatcgcgaatacccgtcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcaaccgagcggccaaactggccaccatcaccatcaccattag

SEQ ID NO: 820 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 821 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttcgcctggcgaccattgtgcaggacgttccgattaaagatctggaaaccagcaccctgaccctggcgatcgcggcgaccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcagccgagcggccaaactggccaccatcaccatcaccattag

SEQ ID NO: 822 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVRLATIVQDVPIKDLETSTLTLAIAATDLIKSIKVSVDIEHLRIGDLVVTLKAPVEMGVDPMLLHNREGAATDNIKKTYDVVNAPGLAACKGKSPQGTWTLEVADSVWRDIGKMRSFTLELGFEQPSGQTGHHHHHH

SEQ ID NO: 823 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaatacccgtcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgcagcgtgacattggcaagatgcgtagctttaccctggaactgggctttgagcagccgagcggccaaactggccaccatcaccatcaccattag

SEQ ID NO: 824 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADSVQRDIGKMRSFTLELGFEQPSGQTGHHHHHH

SEQ ID NO: 825 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccctcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcgcccgagcggccaaactggccaccatcaccatcaccattag

SEQ ID NO: 826 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTLVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADSVWRDIGKMRSFTLELGFERPSGQTGHHHHHH

SEQ ID NO: 827 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcctggttagcctgtttaccattgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcgcccgagcggccaaactggccaccatcaccatcaccattag

SEQ ID NO: 828 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSLVSLFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADSVWRDIGKMRSFTLELGFERPSGQTGHHHHHH

SEQ ID NO: 829 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagcatttttaccattgtgcaggacgttccgattaaagatctggaaaccagcaccctgaccctggcgatcgcgaatacccgtcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 830 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWDEVREIIKQSCDRIDQAGGNYDASGHSPFYGYGRMNARKAVELAMPEWPSPVSIFTIVQDVPIKDLETSTLTLAIANTRRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 831 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgtggcgtgacattggcaagatgcgtagctttaccctggaactgggctttgagcagccgagcggccaaactggccaccatcaccatcaccattag

SEQ ID NO: 832 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVWRDIGKMRSFTLELGFEQPSGQTGHHHHHH

SEQ ID NO: 833 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 834 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 835 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacgttcagaagtttccgctgccggacagcacccgttgcgcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatagcgtgtggcgtgacattggcaagatgcgtagctttaccctggaactgggctttgagcaaccgagcggccaaactggccaccatcaccatcaccattag

SEQ ID NO: 836 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHVQKFPLPDSTRCAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADSVWRDIGKMRSFTLELGFEQPSGQTGHHHHHH

SEQ ID NO: 837 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgacctcggttagcccggaggcgcgtaacatcctggaccagttcgagctggaaacccgttttcgtgaggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcaagcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 838 - protein, 676 aa, Artificial Sequence
  Variant of serine endopeptidase from Microcoleus sp. PCC 7113
MVTVRYGGKNGEPYELTISDEHIVVRTENRSILTETRPYEVTSVSPEARNILDQFELETRFREAGVEILRAKDPRENSALRDTARVILNQEPEIQFAGRVLVDPQSKQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 839 - DNA, 2031 bp, Artificial Sequence
  Variant of serine endopeptidase from Microcoleus sp. PCC 7113
atggtgaccgtgcgttatggcggccgtaatggtgaaccgtatgaactggcgatcagcgacgagcatattgttgtgcgtaccgagagtcgtagcgccctgatggaggatcgtccgtacgaggtgaccagcgttagcccggaggcgcgtaacatcctggaccagttcgagctggaaacccgttttcgtgaggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 840 - protein, 676 aa, Artificial Sequence
  Variant of serine endopeptidase from Microcoleus sp. PCC 7113
MVTVRYGGRNGEPYELAISDEHIVVRTESRSALMEDRPYEVTSVSPEARNILDQFELETRFREAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 841 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaatcgtagcgccctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 842 - protein, 676 aa, Artificial Sequence
  Variant of serine endopeptidase from Microcoleus sp. PCC 7113
MVTVRYGGRNGEPYELTISDEHIVVRTENRSALTETRPYEVTPVSPEARNILDQFELETRFRAAGVEILRAKDPRENSALRDTARVILNQEPEIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 843 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagaaccgtagcattctgacggggactcgtccgtacgaggtgacctcggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctggagtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 844 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPEIQFAGRVLVDPQSMQPVVYTENIFVKFDDETQSGACQEILERYGLTIKRELEYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 845 - DNA, 2031 bp, Artificial Sequence
  Variant of serine endopeptidase from Microcoleus sp. PCC 7113
atggtgaccgtgcgttatggcggcaagaatggtgaaccgtatgaactgacgatcagcgacgagcatattgttgtgcgtaccgagaaccgtagcatcctgaccgaaacccgtccgtacgaggtgaccccggttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggagattcaattcgcgggccgtgtgctggttgatccgcagagcatgcaaccggtggtttacaccgagaacatcttcgtgaagtttgacgatgaaacccagagcagtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 846 - protein, 676 aa, Artificial Sequence
  Variant of serine endopeptidase from Microcoleus sp. PCC 7113
MVTVRYGGKNGEPYELTISDEHIVVRTENRSILTETRPYEVTPVSPEARNILDQFELETRFRAAGVEILRAKDPRENSALRDTARVILNQEPEIQFAGRVLVDPQSMQPVVYTENIFVKFDDETQSSACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 847 - DNA, 2031 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaatcgtagcgccctgatggaggatcgtccgtacgaggtgaccagcgttagcccggaggcgcgtagcatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcaagcaaccggtggtttacaccgagaacatcttcgtgaagtttgacgatgaaacccagagcagtgcgtgccaagagatcctggaacgttatggcctgaccattaaacgtgagctggggtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 848 - protein, 676 aa, Artificial Sequence
  Variant of serine endopeptidase from Microcoleus sp. PCC 7113
MVTVRYGGKNGEPYELAISDEHIVVRTENRSALMEDRPYEVTSVSPEARSILDQFELETRFRAAGVEILRAKDPREDSALRDTARVILNQEPAIQFAGRVLVDPQSKQPVVYTENIFVKFDDETQSSACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 849 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcctgggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccggtcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgtggcgtgacattggcaagatgcgtagctttaccctggaactgggctttgagcagccgagcggccaaactggccaccatcaccatcaccattag

SEQ ID NO: 850 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTILGQAINADANVEAAWSLSNGTGTTIAIIDDGVDLDHEEFRTAGKIVAPRDVTRKTNDPVPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVWRDIGKMRSFTLELGFEQPSGQTGHHHHHH

SEQ ID NO: 851 - DNA, 2031 bp, Artificial Sequence
  Variant of serine endopeptidase from Microcoleus sp. PCC 7113
atggtgaccgtgcgttatggcggccgtaatggtgaaccgtatgaactgacgatcagcgacgagcatattgttgtgcgtaccgagagtcgtagcattctgatggggactcgtccgtacgaggtgacctcggttagcccggaggcgcgtaacatcctggaccagttcgagctggaaacccgttttcgtgcggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctggggtacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 852 - protein, 676 aa, Artificial Sequence
  Variant of serine endopeptidase from Microcoleus sp. PCC 7113
MVTVRYGGRNGEPYELTISDEHIVVRTESRSILMGTRPYEVTSVSPEARNILDQFELETRFRAAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 853 - DNA, 2031 bp, Artificial Sequence
  Variant of serine endopeptidase from Microcoleus sp. PCC 7113
atggtgaccgtgcgttatggcggcaagaatggtgaaccgtatgaactggcgatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgaggcgggtgtggagattctgcgtgcgaaggacccgcgtgaagacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaaccagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccgggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcaaccgagcggccaaactggccaccatcaccatcaccattag

SEQ ID NO: 854 - protein, 676 aa, Artificial Sequence
  Variant of serine endopeptidase from Microcoleus sp. PCC 7113
MVTVRYGGKNGEPYELAISDEHIVVRTENRSILTETRPYEVTSVSPEARNILDQFELETRFREAGVEILRAKDPREDSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 855 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaaattcagcgtgacattggcaagatgcgtagctttaccctggaactgggctttgagcgcccgagcggccaaactggccaccatcaccatcaccattag

SEQ ID NO: 856 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKIQRDIGKMRSFTLELGFERPSGQTGHHHHHH

SEQ ID NO: 857 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaaatgcagcgtgacattggcaagatgcgtagctttaccctggaactgggctttgagcgcccgagcggccaaactggccaccatcaccatcaccattag

SEQ ID NO: 858 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKMQRDIGKMRSFTLELGFERPSGQTGHHHHHH

SEQ ID NO: 859 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtgtgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 860 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRVGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 861 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgattcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 862 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDSAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 863 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaaaggcagcgtgacattggcaagatgcgtagctttaccctggaactgggctttgagcgcccgagcggccaaactggccaccatcaccatcaccattag

SEQ ID NO: 864 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKRQRDIGKMRSFTLELGFERPSGQTGHHHHHH

SEQ ID NO: 865 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatttggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 866 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDLAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 867 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatatggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 868 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDMAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 869 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgaggaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 870 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPRNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 871 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgttatattggcaagatgcgtagctttaccctggaactgggctttgagcgcccgagcggccaaactggccaccatcaccatcaccattag

SEQ ID NO: 872 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRYIGKMRSFTLELGFERPSGQTGHHHHHH

SEQ ID NO: 873 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtatttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 874 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGIWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 875 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtgagcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 876 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGERDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 877 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacccgcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 878 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINPRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 879 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtggtcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 880 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGGRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 881 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacgctcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 882 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINARQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 883 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtacgattggcaagatgcgtagctttaccctggaactgggctttgagcgcccgagcggccaaactggccaccatcaccatcaccattag

SEQ ID NO: 884 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRTIGKMRSFTLELGFERPSGQTGHHHHHH

SEQ ID NO: 885 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatctggaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctggggagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 886 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREIWKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 887 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacattcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 888 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINIRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 889 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcttgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 890 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTILQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 891 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggttggcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 892 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGWRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 893 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagctggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggctgagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggacgctggaagttgccgataaagtgcagcgtgacattggcaagatgcgtagctttaccctggaactgggctttgagcgcccgagcggccaaactggccaccatcaccatcaccattag

SEQ ID NO: 894 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPAEMGVDPMLLHNREGAATDNIKKTYDVVNAPGLAACKGKSPQGTWTLEVADKVQRDIGKMRSFTLELGFERPSGQTGHHHHHH

SEQ ID NO: 895 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaactgcagcgtgacattggcaagatgcgtagctttaccctggaactgggctttgagcgcccgagcggccaaactggccaccatcaccatcaccattag

SEQ ID NO: 896 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKLQRDIGKMRSFTLELGFERPSGQTGHHHHHH

SEQ ID NO: 897 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtttgcgtgataaccatggtaccgcgtgcgcgggtgtggcgtgcgcgaacggtaaagttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 898 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGLRDNHGTACAGVACANGKVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 899 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggttatcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 900 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGYRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 901 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtgttcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 902 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGVRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 903 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtctgcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 904 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGLRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 905 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtatgcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 906 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGMRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 907 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtagtcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 908 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGSRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 909 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtgcgcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 910 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 911 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagctggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcgaactgaccctggcgatcgcgaataccgatctgatcaagagcattaaagtgagcgttgtcatcgaacacctgcgtatcggcgatctggtggttaccctgaaggcgccggctgagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 912 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSELTLAIANTDLIKSIKVSVVIEHLRIGDLVVTLKAPAEMGVDPMLLHNREGAATDNIKKTYDVVNAPGLAACKGKSPQGTWTLEVADKVQRDIGKMRSFTLELGFERPSGQTGHHHHHH

SEQ ID NO: 913 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgatcccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgcccaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatcgtatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgtgacattggcaagatgcgtagctttaccctggaactgggctttgagcgcccgagcggccaaactggccaccatcaccatcaccattag

SEQ ID NO: 914 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPIPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWEEVREIIKQSCDRIDQAGGNYDASGHSPFYGYGRMNARKAVELAMPEWPSPVSIFTIVQDVPIKDLETSTLTLAIANTDRIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 915 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaggcgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 916 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGRRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 917 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagtttcgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 918 - protein, 676 aa, Artificial Sequence
  Variant of serine endopeptidase from Microcoleus sp. PCC 7113
MVTVRYGGRNGEPYELTISDEHIVVRTEFRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 919 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaatatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgtcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagctatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagcggccaaactggccaccatcaccatcaccattag

SEQ ID NO: 920 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 921 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaagggaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 922 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREGNKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 923 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgaggggcgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 924 - protein, 676 aa, Artificial Sequence
  Variant of serine endopeptidase from Microcoleus sp. PCC 7113
MVTVRYGGRNGEPYELTISDEHIVVRTEGRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 925 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgtgtagctttaccctggaactgggctttgagcgcccgagcggccaaactggccaccatcaccatcaccattag

SEQ ID NO: 926 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMCSFTLELGFERPSGQTGHHHHHH

SEQ ID NO: 927 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgtcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagcggccaaactggccaccatcaccatcaccattag

SEQ ID NO: 928 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 929 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgtcgatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 930 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLSIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 931 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgacacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 932 - protein, 676 aa, Artificial Sequence
  Variant of serine endopeptidase from Microcoleus sp. PCC 7113
MVTVRYGGRNGEPYELTISDEHIVVRTENRSILTDTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 933 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgtagcatcctgaccgagacccgtccgtacgaggtgaccagcgttagcccggaggcgcgtagtatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 934 - protein, 676 aa, Artificial Sequence
  Variant of serine endopeptidase from Microcoleus sp. PCC 7113
MVTVRYGGRNGEPYELTISDEHIVVRTESRSILTETRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 935 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtagtatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgtcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtccgcagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 936 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 937 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgcgataaccatggtaccgcgtgcgcgggtgtggcgtgcgcgaacggtaacgttggtgcgagcggtgttgcgccgggtgcggccctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgccctgggttacaaccgtggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgcgcggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 938 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGAALMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDASGHSPFYGYGRMNARAAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 939 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgtatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 940 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLYIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 941 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 942 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSLVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 943 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttaccctgaagaccaacgacccgcgtccgggtaaccgcgataaccatggtaccgcgtgcgcgggtgtggcgtgcgcgaacggtaacgttggtgcgagcggtgttgcgccgggtgcgcgcctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgcaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 944 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTLKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 945 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgtcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 946 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 947 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 948 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 949 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcctgaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcacgatgcgtagctttaccctggaactgggctttgagcgcccgagcggccaaactggccaccatcaccatcaccattag

SEQ ID NO: 950 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSLTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGTMRSFTLELGFERPSGQTGHHHHHH

SEQ ID NO: 951 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctggggatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 952 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 953 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacacgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 954 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYTRNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 955 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcactaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 956 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREITKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 957 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcacgatgcgtagctttaccctggaactgggctttgagcgcccgagcggccaaactggccaccatcaccatcaccattag

SEQ ID NO: 958 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGTMRSFTLELGFERPSGQTGHHHHHH

SEQ ID NO: 959 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgtcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 960 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 961 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattcagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 962 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIQKTYDVVNAPGLAACKGKSPQGTWTLEVADKVQRDIGKMRSFTLELGFERPSGQTGHHHHHH

SEQ ID NO: 963 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccgtggtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 964 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTVVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 965 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggctatatgcgtagctttaccctggaactgggctttgagcgcccgagcggccaaactggccaccatcaccatcaccattag

SEQ ID NO: 966 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGYMRSFTLELGFERPSGQTGHHHHHH

SEQ ID NO: 967 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcggccctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 968 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGAALMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 969 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggccagatgcgtagctttaccctggaactgggctttgagcgcccgagcggccaaactggccaccatcaccatcaccattag

SEQ ID NO: 970 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGQMRSFTLELGFERPSGQTGHHHHHH

SEQ ID NO: 971 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggccttatgcgtagctttaccctggaactgggctttgagcgcccgagcggccaaactggccaccatcaccatcaccattag

SEQ ID NO: 972 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGLMRSFTLELGFERPSGQTGHHHHHH

SEQ ID NO: 973 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 974 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 975 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgtttcacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 976 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 977 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcggtgaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 978 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNAVKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 979 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcgtggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 980 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEIVERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 981 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagcggccaaactggccaccatcaccatcaccattag

SEQ ID NO: 982 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEWPSGQTGHHHHHH

SEQ ID NO: 983 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgccctgggttacaaccgtggtaacctgcgccagggtgatgcggcgggtaactataccaacagctttggtggcaccagcagctcgtgccaaggtgcggcgggagtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 984 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 985 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggcagaagcggatgcgtttgtttgggcggcgcaaaacggtgcggatgttattagctgcagctggggtccgccggacggtgtttggtacaacccgtgggatccgctgcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagctatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 986 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQAEADAFVWAAQNGADVISCSWGPPDGVWYNPWDPLHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 987 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggattctggaagttgccgataaagtgcagcgtgacattggcaagatgcgtagctttaccctggaactgggctttgagcgcccgagcggccaaactggccaccatcaccatcaccattag

SEQ ID NO: 988 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWILEVADKVQRDIGKMRSFTLELGFERPSGQTGHHHHHH

SEQ ID NO: 989 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaatatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaagaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 990 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 991 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcaggacattggcaagatgcgtagctttaccctggaactgggctttgagcgcccgagcggccaaactggccaccatcaccatcaccattag

SEQ ID NO: 992 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQQDIGKMRSFTLELGFERPSGQTGHHHHHH

SEQ ID NO: 993 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggtggacattggcaagatgcgtagctttaccctggaactgggctttgagcgcccgagcggccaaactggccaccatcaccatcaccattag

SEQ ID NO: 994 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQVDIGKMRSFTLELGFERPSGQTGHHHHHH

SEQ ID NO: 995 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 996 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 997 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 998 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 999 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgaggggccgagcggccaaactggccaccatcaccatcaccattag

SEQ ID NO: 1000 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEGPSGQTGHHHHHH

SEQ ID NO: 1001 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatggggtgcagcgtgacattggcaagatgcgtagctttaccctggaactgggctttgagcgcccgagcggccaaactggccaccatcaccatcaccattag

SEQ ID NO: 1002 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADGVQRDIGKMRSFTLELGFERPSGQTGHHHHHH

SEQ ID NO: 1003 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagacgctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1004 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQETLERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1005 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtcgtgcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1006 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARRAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1007 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgcctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccgtggtaacctgcgccagggtgatgcggcgggtaactataccaacagctttggtggcaccagcagctcgtgccaaggtgcggcgggtgtggcggcgctgatcattgcggtaaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgcaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1008 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIAVNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1009 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttggggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1010 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVGACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1011 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgctgcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagctatatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcagccgagcggccaaactggccaccatcaccatcaccattag

SEQ ID NO: 1012 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPSGQTGHHHHHH

SEQ ID NO: 1013 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagggcagcgtgacattggcaagatgcgtagctttaccctggaactgggctttgagcgcccgagcggccaaactggccaccatcaccatcaccattag

SEQ ID NO: 1014 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKGQRDIGKMRSFTLELGFERPSGQTGHHHHHH

SEQ ID NO: 1015 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaatttggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1016 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQFGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1017 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgaggtgccgagcggccaaactggccaccatcaccatcaccattag

SEQ ID NO: 1018 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFEVPSGQTGHHHHHH

SEQ ID NO: 1019 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1020 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDEVNAPGLAACKGKSPQGTWTLEVADKVQRDIGKMRSFTLELGFERPSGQTGHHHHHH

SEQ ID NO: 1021 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgatgaggtgcagcgtgacattggcaagatgcgtagctttaccctggaactgggctttgagcgcccgagcggccaaactggccaccatcaccatcaccattag

SEQ ID NO: 1022 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADEVQRDIGKMRSFTLELGFERPSGQTGHHHHHH

SEQ ID NO: 1023 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgagacccgtccgtacgaggtgaccagcgttagcccggaggcgcgtagtatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaagaagcggatgcgtttgtttgggcggcgcaaaacggtgcggatgttattagctgcagctggggtccgccggacggtgtttggtacaacccgtgggatccgctgcacaatcagaaatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggatttgagcgcccgagcggccaaactggccaccatcaccatcaccattag

SEQ ID NO: 1024 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARSILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1025 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1026 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1027 - DNA, 2031 bp, Artificial Sequence; identical to SEQ ID NO: 863
  Variant of serine endopeptidase from Microcoleus sp. PCC 7113

SEQ ID NO: 1028 - protein, 676 aa, Artificial Sequence; identical to SEQ ID NO: 864
  Variant of serine endopeptidase from Microcoleus sp. PCC 7113

SEQ ID NO: 1029 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1030 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1031 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccctggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcacgatgcgtagctttaccctggaactgggctttgagcgcccgagcggccaaactggccaccatcaccatcaccattag

SEQ ID NO: 1032 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNPGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGTMRSFTLELGFERPSGQTGHHHHHH

SEQ ID NO: 1033 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacgcgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1034 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHARIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1035 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgagtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1036 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1037 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcataccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1038 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRHTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1039 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggagctggaagttgccgataaagtgcagcgtgacattggcaagatgcgtagctttaccctggaactgggctttgagcgcccgagcggccaaactggccaccatcaccatcaccattag

SEQ ID NO: 1040 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWELEVADKVQRDIGKMRSFTLELGFERPSGQTGHHHHHH

SEQ ID NO: 1041 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaataccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1042 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRNTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1043 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtgctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1044 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1045 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaaatgggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1046 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQMGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1047 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1048 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1049 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagcatccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1050 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEHPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1051 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgattgggtgcagcgtgacattggcaagatgcgtagctttaccctggaactgggctttgagcgcccgagcggccaaactggccaccatcaccatcaccattag

SEQ ID NO: 1052 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADWVQRDIGKMRSFTLELGFERPSGQTGHHHHHH

SEQ ID NO: 1053 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtgatgcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1054 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARDAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1055 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagcggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1056 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDASGHSPFYGYGRMNARKAVELAMPERPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1057 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgacccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgtcagcggtctgggcagccaggaggaagcggatgcgtttgtttgggcggcgcaaaacggtgcggatgttattagctgcagctggggtccgccggacggtgtttggtacaacccgtgggatccgcgccacaatcagaagtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgccctgggttacaaccctggtaacctgcgtcagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgatgcgagtggtcatagcccgttctacggttatggccgtatgaacgcgctgaaggcggtggaactggcgatgccggagtggccaagcccggttagtatctttaccatcgtgcaggacgttccgattaaagatctggaaaccagcaccctgaccctggcgatcgcgaataccgatctgatcaagagcattaaagtgagcgttgacatcgaacacctgcgtatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1058 - protein, 676 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPRHNQKFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNPGNLRQGDAAGNYTNSFGGTSSSCQGAAGVAALIIARNPNLRWEEVREIIKQSCDRIDQAGGNYDASGHSPFYGYGRMNALKAVELAMPEWPSPVSIFTIVQDVPIKDLETSTLTLAIANTDLIKSIKVSVDIEHLRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1059 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggaactggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtgttgcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1060 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVELDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARVAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1061 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagcggccaaactggccaccatcaccatcaccattag

SEQ ID NO: 1062 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWVLEVADKVQRDIGKMRSFTLELGFERPSGQTGHHHHHH

SEQ ID NO: 1063 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagcggccaaactggccaccatcaccatcaccattag

SEQ ID NO: 1064 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWVLEVADKVQRDIGKMRSFTLELGFERPSGQTGHHHHHH

SEQ ID NO: 1065 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1066 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1067 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccgggggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1068 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPGARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1069 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcctgaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1070 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREILKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1071 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaaccagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacggcggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1072 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINQRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNGGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1073 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtcacaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgctgcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctatggttatggccgtatgaacgcgcgcaaggcggtggaactggcgatgccggagtggccaagcctggttagtatctttaccattgtgcaggacgttccgattaaagatctggaaaccagcaccctgaccctggcgatcgcgaataccgatctgatcaagagcattaaagtgagcgttgacatcgaacacagcagcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaggtgcagcaggacattggcaagatgcgtagctttaccctggaactgggctttgagcgcccgagcggccaaactggccaccatcaccatcaccattag

SEQ ID NO: 1074 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRHTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSSIGDLVVTLKAPVEMGVDPMLLHNREGAATDNIKKTYDVVNAPGLAACKGKSPQGTWTLEVADKVQQDIGKMRSFTLELGFERPSGQTGHHHHHH

SEQ ID NO: 1075 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcccgaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1076 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSPTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1077 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtgaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1078 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNAREAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1079 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtcttgcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1080 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARLAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1081 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtatggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1082 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARMAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1083 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtagggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1084 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARRAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1085 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtactgcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1086 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARTAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1087 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1088 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1089 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaccgtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1090 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSITVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1091 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaccacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1092 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPSGQTGHHHHHH

SEQ ID NO: 1093 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggccagagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1094 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGQSPQGTWTLEVADKVQRDIGKMRSFTLELGFERPSGQTGHHHHHH

SEQ ID NO: 1095 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaggcggtggaactggcgatgccggagtggccaagcctggttagtatctttaccgttgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1096 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTVVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1097 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgctgcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcggtaaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1098 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNAVKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFEGPSGQTGHHHHHH

SEQ ID NO: 1099 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaaaaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgttccacaatcaggtatttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagcggcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1100 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPFHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1101 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatccgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1102 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1103 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtgtgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1104 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRVNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1105 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatccgtagctttaccctggaactgggctttgagcgtccgagcggccaaactggccaccatcaccatcaccattag

SEQ ID NO: 1106 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKIRSFTLELGFERPSGQTGHHHHHH

SEQ ID NO: 1107 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagcggccaaactggccaccatcaccatcaccattag

SEQ ID NO: 1108 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWVLEVADKVQRDIGKMRSFTLELGFERPSGQTGHHHHHH

SEQ ID NO: 1109 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggatcctggaagttgccgataaagtgcagcgtgacattggcaagatgcgtagctttaccctggaactgggctttgagcgtccgagcggccaaactggccaccatcaccatcaccattag

SEQ ID NO: 1110 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWILEVADKVQRDIGKMRSFTLELGFERPSGQTGHHHHHH

SEQ ID NO: 1111 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctggatcctggaagttgccgataaagtgcagcgtgacattggcaagatgcgtagctttaccctggaactgggctttgagcgtccgagcggccaaactggccaccatcaccatcaccattag

SEQ ID NO: 1112 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWILEVADKVQRDIGKMRSFTLELGFERPSGQTGHHHHHH

SEQ ID NO: 1113 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtctgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1114 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGLRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1115 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcatctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggatcctggaagttgccgataaagtgcagcgtgacattggcaagatgcgtagctttaccctggaactgggctttgagcgtccgagcggccaaactggccaccatcaccatcaccattag

SEQ ID NO: 1116 - protein, 676 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRHLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWILEVADKVQRDIGKMRSFTLELGFERPSGQTGHHHHHH

SEQ ID NO: 1117 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1118 - protein, 676 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1119 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1120 - protein, 676 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1121 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtctgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgaagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1122 - protein, 676 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGLRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDEVNAPGLAACKGKSPQGTWTLEVADKVQRDIGKMRSFTLELGFERPSGQTGHHHHHH

SEQ ID NO: 1123 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagggccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagcggccaaactggccaccatcaccatcaccattag

SEQ ID NO: 1124 - protein, 676 aa, Artificial Sequence
  Variant of serine endopeptidase from Microcoleus sp. PCC 7113
MVTVRYGGRNGEPYELTISDEHIVVRTEGRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWVLEVADKVQRDIGKMRSFTLELGFERPSGQTGHHHHHH

SEQ ID NO: 1125 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagtcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1126 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1127 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaactggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1128 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQELAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1129 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaagagtatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1130 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILEEYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1131 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttagtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1132 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFSTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1133 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgcactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1134 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGALGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1135 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1136 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1137 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgcctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggtactggaagttgccgataaagtgcagcgtgacattggcaagatgcgtagctttaccctggaactgggctttgagcgtccgagcggccaaactggccaccatcaccatcaccattag

SEQ ID NO: 1138 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWVLEVADKVQRDIGKMRSFTLELGFERPSGQTGHHHHHH

SEQ ID NO: 1139 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgacgccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1140 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1141 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaacggggataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1142 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNGDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1143 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaacgggagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1144 - protein, 676 aa, Artificial Sequence
  Variant of serine endopeptidase from Microcoleus sp. PCC 7113
MVTVRYGGRNGEPYELTISDEHIVVRTENGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1145 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggaccctgccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1146 - protein, 676 aa, Artificial Sequence
  Variant of serine endopeptidase from Microcoleus sp. PCC 7113
MVTVRYGGRNGEPYELTISDEHIVVRTENRSILTGTLPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1147 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgagctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1148 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGELGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1149 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcggtgaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1150 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1151 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccagatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1152 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDQIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1153 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcggaaaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1154 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNAEKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1155 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagcttcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1156 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSFIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1157 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagcggccaaactggccaccatcaccatcaccattag

SEQ ID NO: 1158 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQADIGKMRSFTLELGFERPSGQTGHHHHHH

SEQ ID NO: 1159 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatggtgagctttaccctggaactgggctttgagcgtccgagcggccaaactggccaccatcaccatcaccattag

SEQ ID NO: 1160 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMVSFTLELGFERPSGQTGHHHHHH

SEQ ID NO: 1161 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgaatgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1162 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPNENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1163 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1164 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1165 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgaacgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1166 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALNDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1167 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgctggttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1168 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTALVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1169 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1170 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1171 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgcgtccgggtaaccgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacacgcgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1172 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPRPGNRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHTRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1173 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagcggccaaactggccaccatcaccatcaccattag

SEQ ID NO: 1174 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQADIGKMRSFTLELGFERPSGQTGHHHHHH

SEQ ID NO: 1175 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtctggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1176 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARLAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1177 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1178 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1179 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1180 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1181 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcctgaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1182 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREILKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPSGQTGHHHHHH

SEQ ID NO: 1183 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtctggcggtggaactggcgatgccggagtggccaagcctggttagtatctttaccatcgtgcaggacgttccgattaaagatctggaaaccagcaccctgaccctggcgatcgcgaataccgatccgatcaagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1184 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARLAVELAMPEWPSLVSIFTIVQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1185 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcggtcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1186 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPSGQTGHHHHHH

SEQ ID NO: 1187 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1188 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPSGQTGHHHHHH

SEQ ID NO: 1189 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcggtcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagagcagcgtgacattggcaagatgcgtagctttaccctggaactgggctttgagcgtccgagcggccaaactggccaccatcaccatcaccattag

SEQ ID NO: 1190 - protein, 676 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKEQRDIGKMRSFTLELGFERPSGQTGHHHHHH

SEQ ID NO: 1191 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcctgaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1192 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREILKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1193 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1194 - protein, 676 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1195 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1196 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1197 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaggcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagcggccaaactggccaccatcaccatcaccattag

SEQ ID NO: 1198 - protein, 676 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQADIGKMRSFTLELGFERPSGQTGHHHHHH

SEQ ID NO: 1199 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaagacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1200 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1201 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1202 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPSGQTGHHHHHH

SEQ ID NO: 1203 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatccgatcgagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagcggccaaactggccaccatcaccatcaccattag

SEQ ID NO: 1204 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIESIKVSVDIEHSRIGDLVVTLKAPVEMGVDPMLLHNREGAATDNIKKTYDVVNAPGLAACKGKSPQGTWTLEVADKVQADIGKMRSFTLELGFERPSGQTGHHHHHH

SEQ ID NO: 1205 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagacgacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1206 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKTTYDVVNAPGLAACKGKSPQGTWTLEVADKVQRDIGKMRSFTLELGFERPSGQTGHHHHHH

SEQ ID NO: 1207 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagcggcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaagacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1208 - protein, 676 aa, Artificial Sequence
  Variant of serine endopeptidase from Microcoleus sp. PCC 7113
MVTVRYGGRNGEPYELTISDEHIVVRTESGSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1209 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtacggcggtggaactggcgatgccggagtggccaagcctggttagtatctttaccatcgtgcaggacgttccgattaaagatctggaaaccagcaccctgaccctggcgatcgcgaataccgatctgatcaagagcattaaggtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1210 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARTAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1211 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcggagcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgagtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaagaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcggtcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggcggacattggcaagatgcgtagctttaccctggaactgggctttgagcgtccgagcggccaaactggccaccatcaccatcaccattag

SEQ ID NO: 1212 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTASKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIAVNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQADIGKMRSFTLELGFERPSGQTGHHHHHH

SEQ ID NO: 1213 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagagccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1214 - protein, 676 aa, Artificial Sequence
  Variant of serine endopeptidase from Microcoleus sp. PCC 7113
MVTVRYGGRNGEPYELTISDEHIVVRTESRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1215 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgcagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgtcgcgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcccaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccgttgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1216 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSPTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTVVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1217 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtaagcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1218 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1219 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatttggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1220 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1221 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaatgtagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1222 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIECSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1223 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcgaggaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1224 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGARTDNIKKTYDVVNAPGLAACKGKSPQGTWTLEVADKVQRDIGKMRSFTLELGFERPSGQTGHHHHHH

SEQ ID NO: 1225 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcagagtgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1226 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQSVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1227 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccggcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1228 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1229 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1230 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1231 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1232 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPSGQTGHHHHHH

SEQ ID NO: 1233 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagcctggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1234 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSLEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1235 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggtgtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1236 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPVWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1237 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgaactgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgaccaacggtaccggtaccaccatcgcgatcattgacgatggcgtggacctggaccacgaggaatttcgtaccgcgggtaaaattgtggcgccgcgtgacgttacccgtaagaccaacgatccgagcccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1238 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLTNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1239 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcaggacgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1240 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1241 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatattgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1242 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDIAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1243 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctgaccctgggctttgagcgtccgagcggccaaactggccaccatcaccatcaccattag

SEQ ID NO: 1244 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLTLGFERPSGQTGHHHHHH

SEQ ID NO: 1245 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaatgtagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1246 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIECSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1247 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtttgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcaggacgttccgattaaagatctggaaaccagcaccctgaccctggcgatcgcgaataccgatctgatcgaaagcattaaagtgagcgttgacatcgaatgtagccgcatcggcgatctggtggttaccctgaaggcgccggtggagatgggcgttgatccgatgctgctgcataaccgtgagggtgcgcgcaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggagctgggctttgagcgtccgagcggccaaactggccaccatcaccatcaccattag

SEQ ID NO: 1248 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIECSRIGDLVVTLKAPVEMGVDPMLLHNREGARTDNIKKTYDVVNAPGLAACKGKSPQGTWTLEVADKVQRDIGKMRSFTLELGFERPSGQTGHHHHHH

SEQ ID NO: 1249 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1250 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1251 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaatgtagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggagctgggctttgagcgtccgagcggccaaactggccaccatcaccatcaccattag

SEQ ID NO: 1252 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIECSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1253 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1254 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1255 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgattatggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcttgcaggacgttccgattaaagatatggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1256 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDYGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTILQDVPIKDMETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1257 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaaacggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1258 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQANGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1259 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcggtgaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1260 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAVNADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1261 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcattagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1262 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSISNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1263 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattttctttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1264 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1265 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagccaaggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1266 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSQGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1267 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaacagggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1268 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQQGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1269 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccacgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1270 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1271 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcctaaccgtgagggtgcgcgcaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1272 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLPNREGARTDNIKKTYDVVNAPGLAACKGKSPQGTWTLEVADKVQRDIGKMRSFTLELGFERPSGQTGHHHHHH

SEQ ID NO: 1273 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1274 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1275 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggaactgggctttgagcgtccgagcggccaaactggccaccatcaccatcaccattag

SEQ ID NO: 1276 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1277 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccagagtgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggagctgggctttgagcgtccgagcggccaaactggccaccatcaccatcaccattag

SEQ ID NO: 1278 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQSVPIKDLETSTLTLAIANTDPIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPSGQTGHHHHHH

SEQ ID NO: 1279 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctgaccctgggctttgagcgtccgagcggccaaactggccaccatcaccatcaccattag

SEQ ID NO: 1280 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLTLGFERPSGQTGHHHHHH

SEQ ID NO: 1281 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaatgtagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctggaactgggctttgagcgtccgagcggccaaactggccaccatcaccatcaccattag

SEQ ID NO: 1282 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIECSRIGDLVVTLKAPVEMGVDPMLLHNREGAATDNIKKTYDVVNAPGLAACKGKSPQGTWTLEVADKVQADIGKMRSFTLELGFERPSGQTGHHHHHH

SEQ ID NO: 1283 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaatgtagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1284 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIECSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1285 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatttttaccatcgttcaggacgttccgattaaagatctggaaaccagcaccctgaccctggcgatcgcgaataccgatccgatcaaaagcattaaagtgagcgttgacatcgaacacagccgcatcggcgatgtggtggttaccctgaaggcgccggtggagatgggcgttgatccgatgctgctgcataaccgtgagggtgcgcgcaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctgaccctgggctttgagcgtccgagcggccaaactggccaccatcaccatcaccattag

SEQ ID NO: 1286 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGRAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIKSIKVSVDIEHSRIGDVVVTLKAPVEMGVDPMLLHNREGARTDNIKKTYDVVNAPGLAACKGKSPQGTWTLEVADKVQADIGKMRSFTLTLGFERPSGQTGHHHHHH

SEQ ID NO: 1287 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcagagtgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctggagctgggctttgagcgtccgagcggccaaactggccaccatcaccatcaccattag

SEQ ID NO: 1288 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQSVPIKDLETSTLTLAIANTDPIKSIKVSVDIEHSRIGDLVVTLKAPVEMGVDPMLLPNREGAATDNIKKTYDVVNAPGLAACKGKSPQGTWTLEVADKVQADIGKMRSFTLELGFERPSGQTGHHHHHH

SEQ ID NO: 1289 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccagagtgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcataaccgtgagggtgcgcgcaccgacaacattaagaaaacctatgatgtagtgaacgcgccgggtctggcggcgtgcaagggcaaaagcccgcagggtacctggaccctggaagttgccgataaagtgcaggctgacattggcaagatgcgtagctttaccctggagctgggctttgagcgtccgagcggccaaactggccaccatcaccatcaccattag

SEQ ID NO: 1290 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQSVPIKDLETSTLTLAIANTDLIKSIKVSVDIEHSRIGDLVVTLKAPVEMGVDPMLLHNREGARTDNIKKTYDVVNAPGLAACKGKSPQGTWTLEVADKVQADIGKMRSFTLELGFERPSGQTGHHHHHH

SEQ ID NO: 1291 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggagctgggctttgagcgtccgagcggccaaactggccaccatcaccatcaccattag

SEQ ID NO: 1292 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPSGQTGHHHHHH

SEQ ID NO: 1293 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcgtgcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgttcaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1294 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGRAINADANVEAAWSLSNGTGTTIAIIDDGVDLDHEEFRTAGKIVAPRDVTRKTNDPTPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDPIESIKVSVDIEHSRIGDLVVTLKAPVEMGVDPMLLPNREGAATDNIKKTYDVVNAPGLAACKGKSPQGTWTLEVADKVQRDIGKMRSFTLELGFERPSGQTGHHHHHH

SEQ ID NO: 1295 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcggaacgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgactccgggtaaacgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgccgcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgcgacattggcaagatgcgtagctttaccctggaactgggctttgagcgtccgagcggccaaactggccaccatcaccatcaccattag

SEQ ID NO: 1296 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIAERLLNEESVELCHPELVREINKRQAFPQQWHLKPTTIRGQAINADANVEAAWSLSNGTGTTIAIIDDGVDLDHEEFRTAGKIVAPRDVTRKTNDPTPGKRDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFERPSGQTGHHHHHH

SEQ ID NO: 1297 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccattatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1298 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTIIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1299 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaagcgattaacgcggatgcgaacgtggaagcggcgtggagcctgagcaacggtaccggtaccgtgatcgcgatcattgacgatggcgtggacctggaccacgaggaatttcgtaccgcgggtaaaattgtggcgccgcgtgacgttacccgtaagaccaacgatccgagtccgggtgcgcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatgcggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatcgtgcaggacgttccgattaaagatctggaaaccagcaccctgaccctggcgatcgcgaataccgatctgatcaagagcattaaagtgagcgttgacatcgaacacagccgcatcggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1300 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTVIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDAAGNYTNSFGGTSSSCQGAAGVAALIIARNPNLRWEEVREIIKQSCDRIDQAGGNYDSSGHSPFYGYGRMNARKAVELAMPEWPSLVSIFTIVQDVPIKDLETSTLTLAIANTDLIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1301 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacgcccgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcaaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaggtgcagcgcgacattggcaagatgcgtagctttaccctggaactgggctttgagcgtccgagcggccaaactggccaccatcaccatcaccattag

SEQ ID NO: 1302 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINARQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIKSIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1303 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacgcccgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1304 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINARQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1305 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaagccgaccaccatccgtggtcaggcgattaacgcgagtgcgaacgtggaagcggcgtggagcctgagcaacggtaccggtaccgtgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatccgatcaaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagcggccaaactggccaccatcaccatcaccattag

SEQ ID NO: 1306 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTVIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIKSIKVSVDIEHSGIGDLVVTLKAPVEMGVDPMLLHNREGAATDNIKKTYDVVNAPGLAACKGKSPQGTWTLEVADKVQRDIGKMRSFTLELGFEWPSGQTGHHHHHH

SEQ ID NO: 1307 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1308 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1309 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1310 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1311 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1312 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFEGPSGQTGHHHHHH

SEQ ID NO: 1313 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaagccgaccaccatccgtggtcaggcgattaacgcgagtgcgaacgtggaagcggcgtggagcctgagcaacggtaccggtaccgtgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1314 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTVIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1315 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtatgggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaacccctggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgcccgagcggccaaactggccaccatcaccatcaccattag

SEQ ID NO: 1316 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGMGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1317 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaggtgcagcgcgacattggcgtaatgcgtagctttaccctggaactgggctttgagggcccgagcggccaaactggccaccatcaccatcaccattag

SEQ ID NO: 1318 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIMKTYDVVNAPGLAACKGKSPQGTWTLEVADKVQRDIGVMRSFTLELGFEGPSGQTGHHHHHH

SEQ ID NO: 1319 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaagccgaccaccatccgtggtcaggcgattaacgcgagtgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1320 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1321 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1322 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1323 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggccaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1324 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGQSPQGTWTLEVADKVQRDIGKMRSFTLELGFERPSGQTGHHHHHH

SEQ ID NO: 1325 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgtggccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1326 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1327 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgtggccgaccaccatccgtggtcaggcgattaacgcgagtgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1328 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1329 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaacccctggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggccaaagcccgcagggtacctggaccctggaagttgccgataaggtgcagcgcgacattggcaagatgcgtagctttaccctggaactgggctttgagcgtccgagcggccaaactggccaccatcaccatcaccattag

SEQ ID NO: 1330 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIKKTYDVVNAPGLAACKGQSPQGTWTLEVADKVQRDIGKMRSFTLELGFERPSGQTGHHHHHH

SEQ ID NO: 1331 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtatgggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1332 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGMGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1333 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1334 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLPNREGAATDNIKKTYDVVNAPGLAACKGKSPQGTWTLEVADKVQRDIGKMRSFTLELGFEGPSGQTGHHHHHH

SEQ ID NO: 1335 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcggagaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1336 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNAEKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1337 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgcgtaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcaaaagcattaaagtgagcgttgacatcgaacacagccgcatcggcgatctggtggttaccctgaaggcgccggtggagatgggcgttgatccgatgctgctgcctaaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagcggccaaactggccaccatcaccatcaccattag

SEQ ID NO: 1338 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIKSIKVSVDIEHSRIGDLVVTLKAPVEMGVDPMLLPNREGAATDNIKKTYDVVNAPGLAACKGKSPQGTWTLEVADKVQRDIGKMRSFTLELGFEWPSGQTGHHHHHH

SEQ ID NO: 1339 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgtggccgaccaccatccgtggtcaggcgattaacgcggatgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagtggccgagcggccaaactggccaccatcaccatcaccattag

SEQ ID NO: 1340 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFEWPSGQTGHHHHHH

SEQ ID NO: 1341 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1342 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTPGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1343 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaagccgaccaccatccgtggtcaggcgattaacgcgagtgcgaacgtggaagcggcgtggagcctgagcaacggtaccggtaccacgatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggcgtactgggttacaactttggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgcaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagcggcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1344 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTPGIWTTDRMGVLGYNFGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSGIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1345 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgcgcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaaacgtcaggcgttcccgcagcaatggcacctgtggccgaccaccatctcgggtcaggcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattttttttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccgtggtaacctgcgccagggtgatctggcgggtaactataccaacagctttggtggcaccagcagctcgtgccaaggtgcggcgggtgtggcggcgctgatcattgcgcgcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatctgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattaagaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagcgtccgagcggccaaactggccaccatcaccatcaccattag

SEQ ID NO: 1346 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLWPTTISGQAINADANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVIFFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIARNPNLRWEEVREIIKQSCDRIDQAGGNYDSSGHSPFYGYGRMNARKAVELAMPEWPSLVSIFTIRQDVPIKDLETSTLTLAIANTDLIESIKVSVDIEHSRIGDLVVTLKAPVEMGVDPMLLHNREGAATDNIKKTYDVVNAPGLAACKGKSPQGTWTLEVADKVQRDIGKMRSFTLELGFERPSGQTGHHHHHH

SEQ ID NO: 1347 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcgtagcccgttctacggttatggccgtatgaacgcgcgtaaagcggtggaactggcgatgccggagtgggaaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1348 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGRSPFYGYGRMNARKAVELAMPEWESLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1349 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtgggaaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1350 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWESLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1351 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgcatatagcgatttcggcaacgcggtttggtgcgcgtttccgagcaacgacggccgtcctagcaaaaccactggtatttggaccaccgatcgtagcggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccgagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1352 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSAYSDFGNAVWCAFPSNDGRPSKTTGIWTTDRSGVLGYNRGNLRQGDLAGNYTNSFGGTSSSCQGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1353 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtagcggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcgtagcccgttctacggttatggccgtatgaacgcgcgtaaagcggtggaactggcgatgccggagtggccgagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1354 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRSGVLGYNRGNLRQGDLAGNYTNSFGGTSSSCQGAAGVAALIIASNPNLRWEEVREIIKQSCDRIDQAGGNYDSSGRSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1355 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtatatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccaaggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcgtagcccgttctacggttatggccgtatgaacgcgcgtaaagcggtggaactggcgatgccggagtggccgagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1356 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCQGAAGVAALIIASNPNLRWEEVREIIKQSCDRIDQAGGNYDSSGRSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1357 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgcggtggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcgaccaaactggccaccatcaccatcaccattag

SEQ ID NO: 1358 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCGGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSDQTGHHHHHH

SEQ ID NO: 1359 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgcgggggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1360 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCGGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1361 - DNA, 2031 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaatcgtagcatcctgaccgggacccgtccgtacgaggtgaccagcgttagcccggaggcgcgtaacatcctggaccagttcgagctggaaacccgttttcgtgcggcgggtgtggagattctgcgtgcgaaggacccgagcgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtcagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgtggtcaggcgattaacgcgagtgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacgatccgagtccgggtgctcgtgataaccatggtaccgcgtgcgcgggtgtggcgtgcgcgaacggtaacgttggtgcgagcggtgttgcgccgggtgcgcgtctgatgccgatccgttttgtcagcggtctgggcagccaggaggaagcggatgcgtttgtttgggcggcgcaaaacggtgcggatgttattagctgcagctggggtccgccggacggtgtttggtacaacccgtgggatccgctgcacaatcaggtgtttccgctgccggacagcacccgtctggcgatggatttcgcgatcaaccaaggccgtaacggtaagggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccactggtatttggaccaccgatcgtatgggcgtactgggttacaaccggggtaacctgcgccagggtgatctggcgggtaactataccaacagctttggtggcaccagcagctcgtgccctggtgcggcgggtgtggcggcgctgatcattgcgagcaacccgaacctgcgttgggaagaggttcgtgagatcattaagcaaagctgcgaccgtatcgatcaagcaggtggcaactacgattcgagtggtcatagcccgttctacggttatggccgtatgaacgcgcgtaaagcggtggaactggcgatgccggagtggccaagcctggttagtatctttaccatccgccaggacgttccgattaaagatctggaaaccagcaccctgaccctggcgatcgcgaataccgatccgatcgaaagcattaaagtgagcgttgacatcgaacacagccgcatcggcgatctggtggttaccctgaaggcgccggtggagatgggcgttgatccgatgctgctgcataaccgtgagggtgcggcgaccgacaacattatgaaaacctatgatgtagtgaacgcgccgggtctggcggcgtgcaagggcaaaagcccgcagggtacctggaccctggaagttgccgataaagtgcagcgtgacattggcaagatgcgtagctttaccctggaactgggctttgagggcccgagcggccaaactggccaccatcaccatcaccattag

SEQ ID NO: 1362 - protein, 676 aa, Artificial Sequence
  Variant of serine endopeptidase from Microcoleus sp. PCC 7113
MVTVRYGGRNGEPYELTISDEHIVVRTENRSILTGTRPYEVTSVSPEARNILDQFELETRFRAAGVEILRAKDPSENSALRDTARVILNQEPAIQFAGRVLVDPQSMQPVVYTENIFVKFDDETQSGACQEILERYGLTIKRQLGYARNAYFVSAPENTGLTIFDIASRLLNEESVELCHPELVREINKRQAFPQQWHLKPTTIRGQAINASANVEAAWSLSNGTGTTIAIIDDGVDLDHEEFRTAGKIVAPRDVTRKTNDPSPGARDNHGTACAGVACANGNVGASGVAPGARLMPIRFVSGLGSQEEADAFVWAAQNGADVISCSWGPPDGVWYNPWDPLHNQVFPLPDSTRLAMDFAINQGRNGKGCVILFAAGNGNESVDNDGYASYEKVIAVAACNDSSVKSVYSDFGNAVWCAFPSNDGRPSKTTGIWTTDRMGVLGYNRGNLRQGDLAGNYTNSFGGTSSSCPGAAGVAALIIASNPNLRWEEVREIIKQSCDRIDQAGGNYDSSGHSPFYGYGRMNARKAVELAMPEWPSLVSIFTIRQDVPIKDLETSTLTLAIANTDPIESIKVSVDIEHSRIGDLVVTLKAPVEMGVDPMLLHNREGAATDNIMKTYDVVNAPGLAACKGKSPQGTWTLEVADKVQRDIGKMRSFTLELGFEGPSGQTGHHHHHH

SEQ ID NO: 1363 - DNA, 1158 bp, Artificial Sequence
  Variant of triacylglycerol lipase from Bacillus thermoamylovorans
atggagaccagcggtaacgattatccgattgttctggttcacggtttgggtggttggggtaaaggcgaaatgctgggttaccgttactggggtggtctgaaggacatcgagggttatttgaaccaaaccggtcatcgtacctacacggctaccgttggtccggttagcagcaattgggatcgtgcggttgaattgtactattacattcatggtggtaccgttgactacggtgctgcgcacgctaaagagcacggtcatgcgcgtttcggtcgtacctatccgggtatttacggtcaatgggatgaaaccaataagattcacctgatcggtcatagcatgggtggtcagaccagccgtatgttggttgagctgttgaagagcggtagccaaaaagaacaggagtattacagccaacatccggaagagggtattagcccgctgttcgaaggtggtaaaaactgggttcacagcgttaccagcattgctaccccgcataatggtagcacctttgcggatcaacgtctgattgttagcttcatcaaggactttattatccacctggctgcggctgcgggtctgaaacaggagagcttgatctatgatttcaagctggaccaatggggtttgaaacgtcagccgggtgagagcttccatgcgtacatgaaccgtgttctgaccagcccgatttgggagagcaatgatatcagcgcttatgacctgaccacccgtggtgcgcaagagctgaaccagtgggtgaagacctacccggacgtttattacttgagctataccggtaacgctagctaccgtgacgttgttaccggtaattattacccgattgggaccatgcacccgctgctgaccttgatcagcctgcgcatgggtcgctacacccgtcaaagcccaccaccggttattgatcgtagctggctgccgaacgacggtatcgttaatgttgttagcgctaagtatccgttcggtcacccgaacagcccgtacactggtgcgattaaacagggtgtttggaatcattttccggttatggaaggttgggatcacatggacttcattaactttatcggtagcaataccccgggttatttcagcatctacggtttttacaacgacgttgctaatcgtgttcatagcctgccgaaa

SEQ ID NO: 1364 - protein, 386 aa, Artificial Sequence
  Variant of triacylglycerol lipase from Bacillus thermoamylovorans
METSGNDYPIVLVHGLGGWGKGEMLGYRYWGGLKDIEGYLNQTGHRTYTATVGPVSSNWDRAVELYYYIHGGTVDYGAAHAKEHGHARFGRTYPGIYGQWDETNKIHLIGHSMGGQTSRMLVELLKSGSQKEQEYYSQHPEEGISPLFEGGKNWVHSVTSIATPHNGSTFADQRLIVSFIKDFIIHLAAAAGLKQESLIYDFKLDQWGLKRQPGESFHAYMNRVLTSPIWESNDISAYDLTTRGAQELNQWVKTYPDVYYLSYTGNASYRDVVTGNYYPIGTMHPLLTLISLRMGRYTRQSPPPVIDRSWLPNDGIVNVVSAKYPFGHPNSPYTGAIKQGVWNHFPVMEGWDHMDFINFIGSNTPGYFSIYGFYNDVANRVHSLPK

SEQ ID NO: 1365 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1366 - protein, 666 aa, Artificial Sequence; identical to SEQ ID NO: 382
  Variant of serine endopeptidase from Microcoleus sp. PCC 7113

SEQ ID NO: 1367 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccgtggtaacgctcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagcccagcgtgacattggcaagatgcgtagctttaccctggaactgggctttgagcaaccgagctag

SEQ ID NO: 1368 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNARQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKAQRDIGKMRSFTLELGFEQPS

SEQ ID NO: 1369 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1370 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1371 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1372 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1373 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccctggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgaggtgaacgcgccgggtctggcggcgtgcaagggcaaaagcccgcagggtacctgggcgctggaagttgcggacaaagcccagcgtgacattggcaagatgcgtagctttaccctggaactgggctttgagcaaccgagctag

SEQ ID NO: 1374 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNLRQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDEVNAPGLAACKGKSPQGTWALEVADKAQRDIGKMRSFTLELGFEQPS

SEQ ID NO: 1375 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccctggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1376 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNPGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1377 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggcgaaagtgcagcgtgacattggcaagatgcgtagctttaccctggaactgggctttgagcaaccgagctag

SEQ ID NO: 1378 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVAAKVQRDIGKMRSFTLELGFEQPS

SEQ ID NO: 1379 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1380 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1381 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccgcgttgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1382 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPRWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1383 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggtgtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1384 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPVWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1385 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgtgatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1386 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVVIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1387 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctggtggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1388 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLVAPVEMGVDPMLLHNREGAATDNIKKTYDVVNAPGLAACKGKSPQGTWALEVADKVQRDIGKMRSFTLELGFEQPS

SEQ ID NO: 1389 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggacaaagtgcagcgtgacattggcaagatgcgtagctttaccctggaactgggctttgagcaaccgagctag

SEQ ID NO: 1390 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVADKVQRDIGKMRSFTLELGFEQPS

SEQ ID NO: 1391 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttagggacaaagtgcagcgtgacattggcaagatgcgtagctttaccctggaactgggctttgagcaaccgagctag

SEQ ID NO: 1392 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVRDKVQRDIGKMRSFTLELGFEQPS

SEQ ID NO: 1393 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcgccgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1394 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAPTDNIKKTYDVVNAPGLAACKGKSPQGTWALEVADKVQRDIGKMRSFTLELGFEQPS

SEQ ID NO: 1395 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcggttaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1396 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAVNQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1397 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgcgggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1398 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLRAPVEMGVDPMLLHNREGAATDNIKKTYDVVNAPGLAACKGKSPQGTWALEVADKVQRDIGKMRSFTLELGFEQPS

SEQ ID NO: 1399 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcgagtaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1400 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGASTDNIKKTYDVVNAPGLAACKGKSPQGTWALEVADKVQRDIGKMRSFTLELGFEQPS

SEQ ID NO: 1401 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcgttgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1402 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGALTDNIKKTYDVVNAPGLAACKGKSPQGTWALEVADKVQRDIGKMRSFTLELGFEQPS

SEQ ID NO: 1403 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaagccgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1404 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPS

SEQ ID NO: 1405 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgaggacaaagtgcagcgtgacattggcaagatgcgtagctttaccctggaactgggctttgagcaaccgagctag

SEQ ID NO: 1406 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVEDKVQRDIGKMRSFTLELGFEQPS

SEQ ID NO: 1407 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggagctggaagttgcggacaaagtgcagcgtgacattggcaagatgcgtagctttaccctggaactgggctttgagcaaccgagctag

SEQ ID NO: 1408 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWELEVADKVQRDIGKMRSFTLELGFEQPS

SEQ ID NO: 1409 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1410 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1411 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtcaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1412 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRQTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1413 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccgtggtaacgctaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1414 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNANQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1415 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtgtgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgcggacaaagtccagcgtgacattggcaagatgcgtagctttaccctggaactgggctttgagcaaccgagctag

SEQ ID NO: 1416 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRVGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1417 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtggtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1418 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1419 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatcagcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaaaaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgtcacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtagcggccgtctgggttacaaccgtggtaacctgaatcagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcgggtggcaactacgatgcgagcggtcgtagcccgttctacggttatggccgtatgaacgcgcgtaaggcggtggaactggcgatgccggagcaggaaagcccggttagtatctttaccgcggtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagcccagcgtgacattggcaagatgcgtagctttaccctggaactgggctttgagcaaccgagctag

SEQ ID NO: 1420 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTISGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRSGRLGYNRGNLNQGDAAGNYTNSFGGTSSACPGAAGVAALIIARNPNLRWDQVREIIKQSCDRIDQAGGNYDASGRSPFYGYGRMNARKAVELAMPEQESPVSIFTAVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKAQRDIGKMRSFTLELGFEQPS

SEQ ID NO: 1421 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccgcgctgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagctag

SEQ ID NO: 1422 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVAAKVQRDIGKMRSFTLELGFEQPS

SEQ ID NO: 1423 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1424 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1425 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtgggagagcccggttagtatctttaccatcgtgcaggacgttccgattaaagatctggaaaccagcaccctgtcgctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagctag

SEQ ID NO: 1426 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLSLAIANTDLIKSIKVSVDIEHSYIGDLVVTLKAPVEMGVDPMLLHNREGAATDNIKKTYDVVNAPGLAACKGKSPQGTWALEVADKVQRDTGKMRSFTLELGFEQPS

SEQ ID NO: 1427 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtacggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1428 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1429 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccgcgctgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttcgcgccaaagtgcagcgtgacattggcaagatgcgtagctttaccctggaactgggctttgagcaaccgagctag

SEQ ID NO: 1430 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPRWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVRAKVQRDIGKMRSFTLELGFEQPS

SEQ ID NO: 1431 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccgcgctgggaaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagctag

SEQ ID NO: 1432 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPRWESPVSIFTIVQDVPIKDLETSTLTLAIANTDLIKSIKVGVDIEHSYIGDLVVTLKAPVEMGVDPMLLHNREGAATDNIKKTYDVVNAPGLAACKGKSPQGTWKLEVAAKVQRDIGKMRSFTLELGFEQPS

SEQ ID NO: 1433 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggtatgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcactggaagttcgcgccaaagtgcagcgtgacattggcaagatgcgtagctttaccctggaactgggctttgagcaaccgagctag

SEQ ID NO: 1434 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPVWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVRAKVQRDIGKMRSFTLELGFEQPS

SEQ ID NO: 1435 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1436 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1437 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgagcaggacgttccgattaaagatctggaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1438 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVRSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIEQDVPIKDLETSTLTLAIANTDLIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1439 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcaccctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1440 - protein, 666 aa, Artificial Sequence
  Variant of serine endopeptidase from Microcoleus sp. PCC 7113
MVTVRYGGRNGEPYELTISDEHIVVRTENRSTLTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1441 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacattgaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1442 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDIDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGCVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1443 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1444 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1445 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagttacattggcgatctggtggttaccctgaagccaccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1446 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPS

SEQ ID NO: 1447 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1448 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1449 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtggcgcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagctag

SEQ ID NO: 1450 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGGATDNIKKTYDVVNAPGLAACKGKSPQGTWALEVADKVQRDIGKMRSFTLELGFEQPS

SEQ ID NO: 1451 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacctgatcaagagcattaaagtgagcgttgacatcgaacacagttacattggcgatctggtggttaccctgaaggcgccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1452 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLQTSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1453 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1454 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDLIKSIKVSVDIEHTYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1455 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattacgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacctgatcaagagcattaaagtgagcgttgacatcgaacacagttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1456 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVRSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLQTSTLTLAIANTDLIKSIKVSVDIEHSYIGDLVVTLKAPVEMGVDPMLLHNREGAATDNIKKTYDVVNAPGLAACKGKSPQGTWTLEVADKVQRDIGKMRSFTLELGFEQPS

SEQ ID NO: 1457 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacattgaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggaccaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacccgatcaagagcattaaagtgagcgttgacatcgaacacagttacattggcgatctggtggttaccctgaagccaccggtggagatgggcgttgatccgatgctgctgcacaaccgtgagggtgccgcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagctag

SEQ ID NO: 1458 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDIDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALILARNPNLRWDQVREIIKQSCDRIDQAGGNYDASGRSPFYGYGRMNARKAVELAMPEWESPVSIFTIVQDVPIKDLQTSTLTLAIANTDPIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPS

SEQ ID NO: 1459 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1460 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1461 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacacttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagctag

SEQ ID NO: 1462 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVRSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDPIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1463 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaagccaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagctag

SEQ ID NO: 1464 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKPPVEMGVDPMLLHNREGAATDNIKKTYDVVNAPGLAACKGKSPQGTWALEVADKVQRDIGKMRSFTLELGFEQPS

SEQ ID NO: 1465 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggaccttgaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1466 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHTYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1467 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctgcaaaccagcaccctgaccctggcgatcgcgaacaccgacctgatcaagagcattaaagtgagcgttgacatcgaacacacttacattggcgatctggtggttaccctgaaggcaccggtggagatgggcgttgatccgatgctgctgcacaaccgtgagggtggcgcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1468 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLQTSTLTLAIANTDLIKSIKVSVDIEHTYIGDLVVTLKAPVEMGVDPMLLHNREGGATDNIKKTYDVVNAPGLAACKGKSPQGTWTLEVADKVQRDIGKMRSFTLELGFEQPS

SEQ ID NO: 1469 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggcgtgcgtagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgcggacaaagtgcagcgtgacattggcaagatgcgtagctttaccctggaactgggctttgagcaaccgagctag

SEQ ID NO: 1470 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSGVRSAYSDFGNAVWCAFPSNDGRPSKTPGIWTTDRMGRLGYNRGNLRQGDAAGNYTNSFGGTSSACPGAAGVAALILARNPNLRWDEVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1471 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggctggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgattctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagctag

SEQ ID NO: 1472 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWALEVADKVQRDTGKMRSFTLELGFEQPS

SEQ ID NO: 1473 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccatggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggaatgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagctag

SEQ ID NO: 1474 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINHGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVAAKVQRDIGKMRSFTLELGFEQPS

SEQ ID NO: 1475 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtacggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggagagcccggttagtatctttaccatcgtgcaggacgttccgattaaagatctggaaaccagcaccctgacgctggcgatcgcgaacaccgacctgatcaagagcattaaagtgagcgttgacatcgaacacagctacattggcgatctggtggttaccctgaaggcgccggtggagatgggcgttgatccgattctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagctag

SEQ ID NO: 1476 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGRSPFYGYGRMNARKAVELAMPEWESPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWALEVADKVQRDTGKMRSFTLELGFEQPS

SEQ ID NO: 1477 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1478 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1479 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggacgaagttcgtgagatcattaagcaaagctgcgaccgtatcgatcaagcaggtggcaactacgatgcgagcggtcgtagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacccgatcaagagcattaaagtgagcgttgacatcgaacacagttacattggcgatctggtggttaccctgaagccaccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttgcggacaaagtgcagcgtgacattggcaagatgcgtagctttaccctggaactgggctttgagcaaccgagctag

SEQ ID NO: 1480 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGRSPFYGYGRMNARKAVELAMPEWESPVSIFTIVQDVPIKDLETSTLTLAIANTDPIKSIKVSVDIEHSYIGDLVVTLKPPVEMGVDPMLLHNREGAATDNIKKTYDVVNAPGLAACKGKSPQGTWTLEVADKVQRDIGKMRSFTLELGFEQPS

SEQ ID NO: 1481 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaagctggaagttgcggccaaagtgcagcgtgacattggcaagatgcgtagctttaccctggaactgggctttgagcaaccgagctag

SEQ ID NO: 1482 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWKLEVAAKVQRDIGKMRSFTLELGFEQPS

SEQ ID NO: 1483 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggaatgggaaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcactggaagttgcggccaaagtgcagcgtgacattggcaagatgcgtagctttaccctggaactgggctttgagcaaccgagctag

SEQ ID NO: 1484 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWESPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVAAKVQRDIGKMRSFTLELGFEQPS

SEQ ID NO: 1485 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccgcgctgggaaagcccggttagtatctttaccatcgagcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcactggaagttgcggccaaagtgcagcgtgacattggcaagatgcgtagctttaccctggaactgggctttgagcaaccgagctag

SEQ ID NO: 1486 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWESPVSIFTIEQDVPIKDLETSTLTLAIANTDLIKSIKVGVDIEHSYIGDLVVTLKAPVEMGVDPMLLHNREGAATDNIKKTYDVVNAPGLAACKGKSPQGTWALEVAAKVQRDIGKMRSFTLELGFEQPS

SEQ ID NO: 1487 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtacggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgcctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcgtagcccgttctacggttatggccgtatgaacgcgcgtaaggcggtggaactggcgatgccggagtggccaagcccggttagtatctttaccatcgtgcaggacgttccgattaaagatctggaaaccagcaccctgtcgctggcgatcgcgaacaccgacctgatcaagagcattaaagtgagcgttgacatcgaacacagctacattggcgatctggtggttaccctgaaggcgccggtggagatgggcgttgatccgattctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1488 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGRSPFYGYGRMNARKAVELAMPEWPSPVSIFTIVQDVPIKDLETSTLSLAIANTDLIKSIKVSVDIEHSYIGDLVVTLKAPVEMGVDPILLHNREGAATDNIKKTYDVVNAPGLAACKGKSPQGTWALEVADKVQRDIGKMRSFTLELGFEQPS

SEQ ID NO: 1489 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgttcggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcatagcccgttctacggttatggccgtatgaacgcgcgtaaggcggtggaactggcgatgccggagtgggaaagcccggttagtatctttaccatcgtgcaggacgttccgattaaagatctggaaaccagcaccctgacgctggcgatcgcgaacaccgacctgatcaagagcattaaagtgagcgttgacatcgaacacagctacattggcgatctggtggttaccctgaaggcgccggtggagacgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccggactag

SEQ ID NO: 1490 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGHSPFYGYGRMNARKAVELAMPEWESPVSIFTIVQDVPIKDLETSTLTLAIANTDLIKSIKVSVDIEHSYIGDLVVTLKAPVETGVDPMLLHNREGAATDNIKKTYDVVNAPGLAACKGKSPQGTWALEVADKVQRDIGKMRSFTLELGFEQPD

SEQ ID NO: 1491 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgttcggcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggggcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtgaaaagcgcgtatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgaatggtcatagcccgttttacggttatggccgtatgaacgcgcgtaaggcggtggaactggcgatgccggagtggccaagcccggttagtatctttaccatcgtgcaggacgttccgattaaagatctggaaaccagcaccctgtcgctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1492 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRSAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINKGRNGKGSVILFAAGNGNESVDNDGYASYEKVIAVAACNDSSVKSAYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDANGHSPFYGYGRMNARKAVELAMPEWPSPVSIFTIVQDVPIKDLETSTLSLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1493 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggtgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1494 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLVSGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1495 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1496 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1497 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgagtctggcgatcgcgaacaccgacctgatcaagagcattaaagtgagcgttgacatcgaacacacttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctggaccctggaagttcgcgataaagtgcagcgtgacattggcaagatgcgtagctttaccctggaactgggctttgagcaaccgagctag

SEQ ID NO: 1498 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLSLAIANTDLIKSIKVSVDIEHTYIGDLVVTLKAPVEMGVDPMLLHNREGAATDNIKKTYDVVNAPGLAACKGKSPQGTWTLEVRDKVQRDIGKMRSFTLELGFEQPS

SEQ ID NO: 1499 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcagttgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1500 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSSCPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1501 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1502 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVGVDIEHSYIGDLVVTLKAPVEMGVDPILLHNREGAATDNIKKTYDVVNAPGLAACKGKSPQGTWALEVADKVQRDIGKMRSFTLELGFEQPS

SEQ ID NO: 1503 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggaatggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccggattag

SEQ ID NO: 1504 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVGVDIEHSYIGDLVVTLKAPVEMGVDPMLLHNREGAATDNIKKTYDVVNAPGLAACKGKSPQGTWALEVADKVQRDTGKMRSFTLELGFEQPD

SEQ ID NO: 1505 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaacaaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagctag

SEQ ID NO: 1506 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINKGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPILLHNREGAATDNIKKTYDVVNAPGLAACKGKSPQGTWALEVADKVQRDTGKMRSFTLELGFEQPS

SEQ ID NO: 1507 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattatgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcggtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1508 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDYAINQGRNGKGSVILFAAGNGNESVDNDGYASYEKVIAVAACNDSGVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1509 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggaatggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacactggcaagatgcgtagctttaccctggaactgggctttgagcaaccgagctag

SEQ ID NO: 1510 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALILARNPNLRWDQVREIIKQSCDRIDQAGGNYDASGHSPFYGYGRMNARKAVELAMPEWPSPVSIFTIVQDVPIKDLETSTLTLAIANTDLIKSIKVGVDIEHSYIGDLVVTLKAPVEMGVDPILLHNREGAATDNIKKTYDVVNAPGLAACKGKSPQGTWALEVADKVQRDTGKMRSFTLELGFEQPS

SEQ ID NO: 1511 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1512 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1513 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcatcgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacctgatcaagagcattaaagtgggcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1514 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPRWPSPVSIFTIVQDVPIKDLETSTLTLAIANTDLIKSIKVGVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1515 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtactgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggattttgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagtgtccgtagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcctggcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccgcgttggccaagcccggttagtatctttaccatcgtgcaggacgttccgattaaagatctggaaaccagcaccctgaccctggcgatcgcgaacaccgacccgatcaagagcattaaagtgagcgttgacatcgaacacagctacattggcgatctggtggttaccctgaaggcgccggtggagatgggcgttgatccgatcctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1516 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVRSVYSDFGNAVWCAFPSNDGRPSKTPGIWTTDRMGRLGYNRGNLRQGDAAGNYTNSFGGTSSACPGAAGVAALILARNPNLRWDQVREIIKQSCDRIDQAGGNYDASGHSPFYGYGRMNARKAVELAMPRWPSPVSIFTIVQDVPIKDLETSTLTLAIANTDPIKSIKVSVDIEHSYIGDLVVTLKAPVEMGVDPILLHNREGAATDNIKKTYDVVNAPGLAACKGKSPQGTWALEVADKVQRDIGKMRSFTLELGFEQPS

SEQ ID NO: 1517 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcatggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtttcgcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1518 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGMDLDHEEFRTAGKIVAPRDVTRKTNLPRPGNRDNHGTACAGVACANGNVGASGVAPGARLMPIRFASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1519 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggagaccagcaccctgactctggcgatcgcgaacaccgacctgatcaagagcattaaagtgagcgttgacatcgaacacagttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1520 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1521 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctgcagaccagcaccctgagtctggcgatcgcgaacaccgacctgatcaagagcattaaagtgagcgttgacatcgaacacagctacattggcgatctggtggttaccctgaaggcgccggtggagacgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1522 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLQTSTLSLAIANTDLIKSIKVSVDIEHSYIGDLVVTLKAPVETGVDPMLLHNREGAATDNIKKTYDVVNAPGLAACKGKSPQGTWALEVADKVQRDIGKMRSFTLELGFEQPS

SEQ ID NO: 1523 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggacgaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctggaaaccagcaccctgaccctggcgatcgcgaacaccgacctgatcaagagcattaaagtgagcgttgacatcgaacacacttacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttcgcgataaagtgcagcgtgacattggcaagatgcgtagctttaccctggaactgggctttgagcaaccgagctag

SEQ ID NO: 1524 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDEVREIIKQSCDRIDQAGGNYDASGHSPFYGYGRMNARKAVELAMPEWPSPVSIFTIVQDVPIKDLETSTLTLAIANTDLIKSIKVSVDIEHTYIGDLVVTLKAPVEMGVDPMLLHNREGAATDNIKKTYDVVNAPGLAACKGKSPQGTWALEVRDKVQRDIGKMRSFTLELGFEQPS

SEQ ID NO: 1525 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggaggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggctgcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagcggtcatagcccgttctacggttatggccgtatgaacgcgcgtaaggcggtggaactggcgatgccggagtggccaagcccggttagtatctttaccatcgtgcaggaggttccgattaaagatctggaaaccagcaccctgaccctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggcgctggaagttgcggacaaagtgcagcgtgacattggcaagatgcgtagctttaccctggaactgggctttgagcaaccgagctag

SEQ ID NO: 1526 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQEEADAFVWAAQNGADVISCSWGPPDGVWYNPWDPRHNQVVPLPDSTRLAMDFAINQGRNGKGCVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQEVPIKDLETSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

SEQ ID NO: 1527 - DNA, 2001 bp, Artificial Sequence
  Variant of serine endopeptidase from Microcoleus sp. PCC 7113
atggtgaccgtgcgttatggcggccgtaatggtgaaccgtatgaactgaccatcagcgacgagcatattgttgtgcgtaccgagaaccgtagcatcctgaccgaaacccgtccgtacgaggtgaccagcgttagcccggaggcgcgtaacatcctggaccagttcgagctggaaacccgttttcgtgcggcgggtgtggagattctgcgtgcgaaggacccgcgtgaaaacagcgcgctgcgtgataccgcgcgtgttatcctgaaccaggaaccggcgattcaattcgcgggccgtgtgctggttgatccgcagagcatgcaaccggtggtttacaccgagaacatcttcgtgaagtttgacgatgaaacccagagcggtgcgtgccaagagatcctggaacgttatggcctgaccattaaacgtgagctgggttacgcgcgtaacgcgtatttcgttagcgcgccggaaaacaccggcctgaccatctttgacattgcgagccgtctgctgaacgaggaaagcgtggagctgtgccacccggagctggttcgtgaaatcaacaagcgtcaggcgttcccgcagcaatggcacctgaaaccgaccaccatccgcggtcaagcgattaacgcggatgcgaacgtggaagcggcgtggagcctgagcaacggtaccggtaccaccatcgcgatcattgacgatggcgtggacctggaccacgaggaatttcgtaccgcgggtaaaattgtggcgccgcgtgacgttacccgtaagaccaacctgccgcgtccgggtaaccgtgataaccatggtaccgcgtgcgcgggtgtggcgtgcgcgaacggtaacgttggtgcgagcggtgttgcgccgggtgcgcgtctgatgccgatccgtctggcgagcggtctgggcagccaggcggaagcggatgcgtttgtttgggcggcgcaaaacggtgcggatgttattagctgcagctggggtccgccggacggtgtttggtacaacccgtgggatccgcgccacaaccaggtggttccgctgccggacagcacccgtctggcgatggatttcgcgatcaaccaaggccgtaacggtaaaggcagcgtgattctgtttgcggcgggtaacggcaacgagagcgttgacaacgatggttacgcgagctatgaaaaggtgatcgcggttgcggcgtgcaacgacagcagcgtcaaaagcgtctatagcgatttcggcaacgcggtttggtgcgcgtttccgagcaacgacggccgtcctagcaaaaccccgggtatttggaccaccgatcgtatgggccgtctgggttacaaccggggtaacctgcgccagggtgatgcggcgggtaactataccaacagctttggtggcaccagcagcgcgtgcccgggtgcggcgggtgtggcggcgctgatcattgcgcgtaacccgaacctgcgttgggaccaggttcgtgagatcattaagcaaagctgcgaccgtatcgatcaagcaggtggcaactacgatgcgagtggtcatagcccgttctacggttatggccgtatgaacgcgcgtaaggcggtggaactggcgatgccggagtggccaagcccggttagtatctttaccatcgtgcaggacgttccgattaaagatctgcagaccagcaccctgactctggcgatcgcgaacaccgacctgatcaagagcattaaagtgagcgttgacatcgaacacagctacattggcgatctggtggttaccctgaaggcgccggtggagatgggcgttgatccgatgctgctgcacaaccgtgagggtgcggcgaccgacaacattaagaaaacctatgatgtagtgaacgcgccgggtctggcggcgtgcaagggcaaaagcccgcagggtacctgggccctggaagttgccgataaagtgcagcgtgacattggcaagatgcgtagctttaccctggaactgggctttgagcaaccgagctag

SEQ ID NO: 1528 - protein, 666 aa, Artificial Sequence
  Variant of serine endopeptidase from Microcoleus sp. PCC 7113
MVTVRYGGRNGEPYELTISDEHIVVRTENRSILTETRPYEVTSVSPEARNILDQFELETRFRAAGVEILRAKDPRENSALRDTARVILNQEPAIQFAGRVLVDPQSMQPVVYTENIFVKFDDETQSGACQEILERYGLTIKRELGYARNAYFVSAPENTGLTIFDIASRLLNEESVELCHPELVREINKRQAFPQQWHLKPTTIRGQAINADANVEAAWSLSNGTGTTIAIIDDGVDLDHEEFRTAGKIVAPRDVTRKTNLPRPGNRDNHGTACAGVACANGNVGASGVAPGARLMPIRLASGLGSQAEADAFVWAAQNGADVISCSWGPPDGVWYNPWDPRHNQVVPLPDSTRLAMDFAINQGRNGKGSVILFAAGNGNESVDNDGYASYEKVIAVAACNDSSVKSVYSDFGNAVWCAFPSNDGRPSKTPGIWTTDRMGRLGYNRGNLRQGDAAGNYTNSFGGTSSACPGAAGVAALIIARNPNLRWDQVREIIKQSCDRIDQAGGNYDASGHSPFYGYGRMNARKAVELAMPEWPSPVSIFTIVQDVPIKDLQTSTLTLAIANTDLIKSIKVSVDIEHSYIGDLVVTLKAPVEMGVDPMLLHNREGAATDNIKKTYDVVNAPGLAACKGKSPQGTWALEVADKVQRDIGKMRSFTLELGFEQPS

(The sequence listing continues in the following parts.)

What is claimed is:

1. A recombinant protease comprising an amino acid sequence comprising at least 85% sequence identity to SEQ ID NO: 2, wherein the amino acid sequence of the recombinant protease comprises at least a substitution at amino acid position 236, 258, 261, 339, 439, 446, or 450, wherein the amino acid positions are numbered with reference to SEQ ID NO: 2.

2. The recombinant protease of claim 1, wherein the amino acid sequence of the recombinant protease comprises at least a substitution at amino acid position 236, wherein the amino acid substitution is 236V.

3. The recombinant protease of claim 1, wherein the amino acid sequence of the recombinant protease comprises at least a substitution at amino acid position 258, wherein the amino acid substitution is 258G/H/K/N/R.

4. The recombinant protease of claim 1, wherein the amino acid sequence of the recombinant protease comprises at least a substitution at amino acid position 261, wherein the amino acid substitution is 261D/G/L/R/S/V.

5. The recombinant protease of claim 1, wherein the amino acid sequence of the recombinant protease comprises at least a substitution at amino acid position 339, wherein the amino acid substitution is 339F/M/S/W.

6. The recombinant protease of claim 1, wherein the amino acid sequence of the recombinant protease comprises at least a substitution at amino acid position 439, wherein the amino acid substitution is 439M.

7. The recombinant protease of claim 1, wherein the amino acid sequence of the recombinant protease comprises at least a substitution at amino acid position 446, wherein the amino acid substitution is 446A/F/G/L/M/R/T/V.

8. The recombinant protease of claim 1, wherein the amino acid sequence of the recombinant protease comprises at least a substitution at amino acid position 450, wherein the amino acid substitution is 450R/W.

9. The recombinant protease of claim 1, wherein the amino acid sequence of the recombinant protease comprises one or more of substitution 236V, 258K, 261L/D, 339W, 439M, 446F/R, and 450R.

10. The recombinant protease of claim 1, wherein the amino acid sequence of the recombinant protease comprises at least 90% sequence identity to SEQ ID NO: 2.

11. The recombinant protease of claim 1, wherein the amino acid sequence of the recombinant protease comprises at least 95% sequence identity to SEQ ID NO: 2.

12. The recombinant protease of claim 1, wherein the amino acid sequence of the recombinant protease comprises at least 98% sequence identity to SEQ ID NO: 2.

13. The recombinant protease of claim 1, wherein the amino acid sequence of the recombinant protease comprises at least 99% sequence identity to SEQ ID NO: 2.

14. The recombinant protease of claim 1, wherein the amino acid sequence of the recombinant protease comprises SEQ ID NO: 34, 190, 292, 342, 382, 400, 454, 562, 638, 680, 756, 812, 1030, 1136, 1180, 1250, 1308, 1364, 1370, 1424, 1532, 1608, 1650, 1726, 1782, 2000, 2106, 2150, 2220, 2278, or 2332.

15. The recombinant protease of claim 1, wherein the recombinant protease exhibits at least one improved property selected from: i) enhanced catalytic activity; ii) increased tolerance to acid pH; iii) increased tolerance to pH 4 or lower; iv) increased tolerance to pH 5 or greater; v) increased tolerance to at least one protease; vi) increased tolerance to at least one bile salt; vii) increased thermotolerance; viii) increased tolerance to autolysis; or a combination of any of i), ii), iii), iv), v), vi), vii), and viii), as compared to a reference protease having the amino acid sequence of SEQ ID NO: 2.

16. The recombinant protease of claim 1, wherein the recombinant protease is purified.

17. A pharmaceutical composition comprising a recombinant protease of claim 1, and a pharmaceutically acceptable excipient and/or carrier.

18. A recombinant polynucleotide comprising a polynucleotide sequence encoding a recombinant protease of claim 1.

19. The recombinant polynucleotide of claim 18, wherein the polynucleotide sequence is codon optimized.

20. The recombinant polynucleotide of claim 18, wherein the polynucleotide sequence comprises SEQ ID NO: 33, 189, 291, 341, 381, 399, 453, 561, 637, 679, 755, 811, 1029, 1135, 1179, 1249, 1307, 1363, 1369, 1423, 1531, 1607, 1649, 1725, 1781, 1999, 2105, 2149, 2219, 2277, or 2331.

21. An expression vector comprising at least a recombinant polynucleotide of claim 18.

22. The expression vector of claim 21, wherein the recombinant polynucleotide is operably linked to a control sequence.

23. The expression vector of claim 22, wherein the control sequence comprises a promoter.

24. A host cell comprising an expression vector of claim 21.

25. The host cell of claim 24, wherein the host cell is a eukaryotic cell or a prokaryotic cell.

26. A method of producing a recombinant protease, comprising culturing the host cell of claim 24, under suitable conditions such that the recombinant protease encoded by the recombinant polynucleotide is produced.

27. The method of claim 26, further comprising recovering the recombinant protease from media or cell.

28. The method of claim 26, further comprising the step of purifying the protease.

29. A method for treating and/or preventing the symptoms of pancreatic insufficiency in a subject, comprising administering to a subject having pancreatic insufficiency an effective amount of a recombinant protease of claim 1.

30. The method of claim 29, wherein the administering is by oral administration.

31. The method of claim 29, wherein the subject is able to eat a diet that is less restricted in its protein content than diets required by subjects exhibiting the symptoms of pancreatic insufficiency.

32. The method of claim 29, wherein the subject is a human patient.

33. The method of claim 32, wherein the human patient is an adult, infant, or child.

34. The recombinant protease of claim 1, wherein the amino acid sequence of the recombinant protease comprises at least 91% sequence identity to SEQ ID NO: 2.

35. The recombinant protease of claim 1, wherein the amino acid sequence of the recombinant protease comprises at least 92% sequence identity to SEQ ID NO: 2.

36. The recombinant protease of claim 1, wherein the amino acid sequence of the recombinant protease comprises at least 93% sequence identity to SEQ ID NO: 2.

37. The recombinant protease of claim 1, wherein the amino acid sequence of the recombinant protease comprises at least 94% sequence identity to SEQ ID NO: 2.

38. The recombinant protease of claim 1, wherein the amino acid sequence of the recombinant protease comprises at least 96% sequence identity to SEQ ID NO: 2.

39. The recombinant protease of claim 1, wherein the amino acid sequence of the recombinant protease comprises at least 97% sequence identity to SEQ ID NO: 2.

* * * * *